US012730106B2

(12) United States Patent
Shea et al.

(10) Patent No.: US 12,730,106 B2
(45) Date of Patent: Sep. 8, 2026

(54) METHOD FOR MONITORING AUTOIMMUNE DISEASE

(71) Applicant: THE REGENTS OF THE UNIVERSITY OF MICHIGAN, Ann Arbor, MI (US)

(72) Inventors: Lonnie D. Shea, Ann Arbor, MI (US); Robert S. Oakes, College Park, MD (US); Aaron Morris, Ann Arbor, MI (US); Kevin Hughes, Ann Arbor, MI (US)

(73) Assignee: THE REGENTS OF THE UNIVERSITY OF MICIGAN, Ann Arbor, MI (US)

( * ) Notice: Subject to any disclaimer, the term of this patent is extended or adjusted under 35 U.S.C. 154(b) by 1285 days.

(21) Appl. No.: 17/286,154

(22) PCT Filed: Oct. 21, 2019

(86) PCT No.: PCT/US2019/057293

§ 371 (c)(1),
(2) Date: Apr. 16, 2021

(87) PCT Pub. No.: WO2020/082090

PCT Pub. Date: Apr. 23, 2020

(65) Prior Publication Data

US 2021/0382050 A1 Dec. 9, 2021

Related U.S. Application Data

(60) Provisional application No. 62/748,366, filed on Oct. 19, 2018.

(51) Int. Cl.

| | |
|---|---|
| ***G01N 33/53*** | (2006.01) |
| ***A61K 45/06*** | (2006.01) |
| ***C12Q 1/68*** | (2018.01) |
| ***C12Q 1/6883*** | (2018.01) |
| ***G01N 33/564*** | (2006.01) |
| ***G01N 33/68*** | (2006.01) |
| ***G01N 33/74*** | (2006.01) |
| ***G01N 33/96*** | (2006.01) |
| ***G06N 20/00*** | (2019.01) |

(52) U.S. Cl.

CPC ........... *G01N 33/564* (2013.01); *A61K 45/06* (2013.01); *C12Q 1/68* (2013.01); *C12Q 1/6883* (2013.01); *G01N 33/53* (2013.01); *G01N 33/5308* (2013.01); *G01N 33/6863* (2013.01); *G01N 33/74* (2013.01); *G01N 33/96* (2013.01); *G06N 20/00* (2019.01); *C12Q 2600/158* (2013.01); *G01N 2800/24* (2013.01); *G01N 2800/285* (2013.01)

(58) Field of Classification Search

CPC ...... G01N 33/48; G01N 33/53; G01N 33/564; G01N 33/6863; G01N 33/68; G01N 33/96; G01N 2800/285; G01N 2800/24; G01N 33/5308; C12Q 2600/158; C12Q 1/68; C12Q 1/6883; A61K 45/06

See application file for complete search history.

(56) References Cited

U.S. PATENT DOCUMENTS

| | | |
|---|---|---|
| 8,663,675 B2 | 3/2014 | Ghanavi |
| 2009/0010885 A1 | 1/2009 | Vandenbark et al. |
| 2014/0072510 A1 | 3/2014 | Shea et al. |
| 2014/0341887 A1 | 11/2014 | Glynn et al. |
| 2015/0190485 A1 | 7/2015 | Shea et al. |
| 2015/0283218 A1 | 10/2015 | Shea et al. |
| 2016/0279219 A1 | 9/2016 | Mooney et al. |
| 2018/0080080 A1 | 3/2018 | Townsend et al. |
| 2018/0275145 A1 | 9/2018 | Axtell et al. |

FOREIGN PATENT DOCUMENTS

| | | |
|---|---|---|
| WO | WO 2017/120486 | 7/2017 |

OTHER PUBLICATIONS

Coleman, R.A. Of mouse and man—what is the value of the mouse in predicting gene expression in humans? Drug Discovery Today 8(6): 233-235, 2003.*

Liu et al. Comparison of differentially expressed genes in T lymphocytes between human autoimmune disease and murine models of autoimmune disease. Clin Immunol 112: 225-230, 2004.*

Seok et al. Genomic responses in mouse models poorly mimic human inflammatory diseases. Proc Natl Acad Sci USA 110(9): 3507-3512, 2013.*

Jiang et al. Local release of dexamethasone from macroporous scaffolds accelerates islet transplant engraftment by promotion of antiinflammatory M2 macrophages. Biomaterials 114: 71-81, 2017.*

Navone et al. Decellularized silk fibroin scaffold primed with adipose mesenchymal stromal cells improves wound healing in diabetic mice. Stem Cell Res Ther 5: 7, 2014.*

Aguado et al., Extracellular matrix mediators of metastatic cell colonization characterized using scaffold mimics of the pre-metastatic niche. Acta Biomater. Mar. 2016;33:13-24.

(Continued)

*Primary Examiner* — Bridget E Bunner
(74) *Attorney, Agent, or Firm* — Casimir Jones, S.C.; Rikki A. Hullinger

(57) ABSTRACT

Provided herein are methods of monitoring progression, regression, or stage of an AID in a subject, measuring a level of expression of a gene, an RNA, or a protein, or a combination thereof, in a sample obtained from a niche at the implantation site of a synthetic scaffold in the subject at a first time point and at a second time point, wherein the expression level measured at the first time point is compared to the expression level measured at the second time point, wherein the difference in the level of expression at the second time point relative to the level of expression at the first time point is indicative of progression, regression, or stage of the autoimmune disease. Related methods of detecting an AID, determining treatment for a subject with an AID, determining efficacy of an AID treatment, or treating an AID, are further provided.

15 Claims, 47 Drawing Sheets

Specification includes a Sequence Listing.

(56) References Cited

OTHER PUBLICATIONS

Aguado et al., Secretome identification of immune cell factors mediating metastatic cell homing. Sci Rep. Dec. 4, 2015;5:17566.
Aguado, B. A. et al. Biomaterial Scaffolds as Pre-metastatic Niche Mimics Systemically Alter the Primary Tumor and Tumor Microenvironment. Adv. Healthc. Mater. 1700903, 1-11 (2018).
Alter et al., Singular value decomposition for genome-wide expression data processing and modeling. Proc Natl Acad Sci U S A. Aug. 29, 2000;97(18):10101-6.
Azarin, et al., In vivo capture and label-free detection of early metastatic cells. Nat Commun. Sep. 8, 2015;6:8094.
Baranzini, S.E., et al. Modular transcriptional activity characterizes the initiation and progression of autoimmune encephalomyelitis., J. Immunol. 174 (2005) 7412-22.
Boersema, G. S. A. et al. Monocyte subsets in blood correlate with obesity related response of macrophages to biomaterials in vitro. Biomaterials. Dec. 2016;109:32-39.
Breiman, L. Random Forests. Mach. Learn. 2001; 45, 5-32.
Bushnell, G. G. et al. Biomaterial Scaffolds Recruit an Aggressive Population of Metastatic Tumor Cells In Vivo. Cancer Res. Apr. 15, 2019;79(8):2042-2053.
Casey, et al., Conjugation of Transforming Growth Factor Beta to Antigen-Loaded Poly(lactide-co-glycolide) Nanoparticles Enhances Efficiency of Antigen-Specific Tolerance. Bioconjug Chem. Mar. 21, 2018;29(3):813-823.
Comabella, M. & Martin, R. Genomics in multiple sclerosis—Current state and future directions. J Neuroimmunol. Jul. 2007;187(1-2):1-8.
Derfuss, T. Personalized medicine in multiple sclerosis: Hope or reality? BMC Med. Oct. 4, 2012;10:116.
Djoba Siawaya JF, et al. An Evaluation of Commercial Fluorescent Bead-Based Luminex Cytokine Assays. PLoS One. Jul. 2, 2008;3(7):e2535.
Eom et al., Comparison of fine-needle aspiration and core needle biopsy under ultrasonographic guidance for detecting malignancy and for the tissue-specific diagnosis of salivary gland tumors. AJNR Am J Neuroradiol. Jun. 2015;36(6):1188-93.
Extended European Search Report for 19873369.3 filed Oct. 21, 2019, mailed Jul. 6, 2022, 14 pages.
Fawaz, C.N., et al. Neuroproteomics and microRNAs studies in multiple sclerosis: Transforming research and clinical knowledge in biomarker research. Expert Rev Proteomics. 2015;12(6):637-50.
Furlan, R. et al. Immunological patterns identifying disease course and evolution in multiple sclerosis patients, J. Neuroimmunol. 165 (2005) 192-200.
Getts, D. R. et al. Microparticles bearing encephalitogenic peptides induce T-cell tolerance and ameliorate experimental autoimmune encephalomyelitis. Nat Biotechnol. Dec. 2012;30(12):1217-24.
Gotovac, K. et al., Personalized Medicine in Neurodegenerative Diseases: How Far Away? Mol Diagn Ther. Feb. 2014;18(1):17-24.
Hachim, D. et al. Effects of Aging upon the Host Response to Implants. J Biomed Mater Res A. May 2017;105(5):1281-1292.
Hauser, S. L. et al. The Neurobiology of Multiple Sclerosis : Genes, Inflammation, and Neurodegeneration. Neuron. Oct. 5, 2006;52(1):61-76.
Hlavaty et al. Tolerance induction using nanoparticles bearing HY peptides in bone marrow transplantation. Biomaterials. Jan. 2016;76:1-10.
Hunter, Z. et al. A Biodegradable Nanoparticle Platform for the Induction of Antigen-Specific Immune Tolerance for Treatment of Autoimmune Disease. ACS Nano. Mar. 25, 2014;8(3):2148-60.
Hutchinson, M., Natalizumab: A new treatment for relapsing remitting multiple sclerosis. Ther Clin Risk Manag. Jun. 2007;3(2):259-68.
International Search Report for PCT/US2019/057293 mailed Jan. 14, 2022, 11 pages.
Jelčić, I., et al. Biomarkers in Multiple Sclerosis, Blue Books Neurol. 35 (2010) 120-146.
King, I. L., et al. Circulating Ly-6C+ myeloid precursors migrate to the CNS and play a pathogenic role during autoimmune demyelinating disease. Blood. Apr. 2, 2009;113(14):3190-7.
Kirby et al., Gene expression assays. Adv Clin Chem. 2007;44:247-92.
Kuo et al., Peptide-Conjugated Nanoparticles Reduce Positive Co-stimulatory Expression and T Cell Activity to Induce Tolerance. Mol Ther. Jul. 5, 2017;25(7):1676-1685.
Lucchinetti, C. et al. Heterogeneity of multiple sclerosis lesions. Ann. Neurol. 47, 707-717 (2000).
Luo et al. Immune Tolerance for Autoimmune Disease and Cell Transplantation. Annu Rev Biomed Eng. Jul. 11, 2016;18:181-205.
Martinelli-Boneschi, F. et al. MicroRNA and mRNA expression profile screening in multiple sclerosis patients to unravel novel pathogenic steps and identify potential biomarkers, Neurosci. Lett. 508 (2012) 4-8.
Mayo, L., et al. The innate immune system in demyelinating disease. Immunol Rev. Jul. 2012;248(1):170-87.
Mccarthy, D. P. et al. An antigen-encapsulating nanoparticle platform for TH1/17 immune tolerance therapy. Nanomedicine. Jan. 2017;13(1):191-200.
Mccormack et al., Natalizumab: a review of its use in the management of relapsing-remitting multiple sclerosis. Drugs. Sep. 2013;73(13):1463-81.
Metz, I. et al. Pathologic Heterogeneity Persists in Early Active Multiple Sclerosis Lesions. Ann Neurol. May 2014;75(5):728-38.
Miller, F. et al. Clinically isolated syndromes suggestive of multiple sclerosis, part 2: Non-conventional MRI, recovery processes, and management. Lancet Neurol. Jun. 2005;4(6):341-8.
Miller, F. et al. Clinically isolated syndromes suggestive of multiple sclerosis, part I: natural history, pathogenesis, diagnosis, and prognosis. Lancet Neurol. May 2005;4(5):281-8.
Miller, S. D., Karpus, W. J. & Davidson, T. S. Experimental Autoimmune Encephalomyelitis in the Mouse. Curr Protoc Immunol, (2007); 1-26.
Morris A.H. et al. Engineered immunological niches to monitor disease activity and treatment efficacy in relapsing multiple sclerosis. Nat Commun. Aug. 3, 2020;11(1):3871.
Morris, A. H. et al. Decellularized materials derived from TSP2-KO mice promote enhanced neovascularization and integration in diabetic wounds. Biomaterials. Jul. 2018;169:61-71.
Morris, A. H., et al. Multicompartment Drug Release System for Dynamic Modulation of Tissue Responses. Adv Healthc Mater. Oct. 2017;6(19).
Navegantes, K. C. et al. Immune modulation of some autoimmune diseases: the critical role of macrophages and neutrophils in the innate and adaptive immunity. J Transl Med. Feb. 15, 2017;15(1):36.
Nickles, D. et al. Blood RNA profiling in a large cohort of multiple sclerosis patients and healthy controls. Hum Mol Genet. Oct. 15, 2013;22(20):4194-205.
Onken, et al., An accurate, clinically feasible multi-gene expression assay for predicting metastasis in uveal melanoma. J Mol Diagn. Jul. 2010;12(4):461-8.
Orellano, L. A. A. et al. Upregulation of Foreign Body Response in Obese Mice. besity (Silver Spring). Mar. 2018;26(3):531-539.
Pearson et al., Controlled Delivery of Single or Multiple Antigens in Tolerogenic Nanoparticles Using Peptide-Polymer Bioconjugates. Mol Ther. Jul. 5, 2017;25(7):1655-1664.
Prasad, et al., Tolerogenic Ag-PLG nanoparticles induce tregs to suppress activated diabetogenic CD4 and CD8 T cells. J. Autoimmun. (2017) 1-13.
Ramanathan, M. et al. In vivo gene expression revealed by cDNA arrays : the pattern in relapsing-remitting multiple sclerosis patients compared with normal subjects. J Neuroimmunol. Jun. 1, 2001;116(2):213-9.
Rao, et al., Enhanced Survival with Implantable Scaffolds That Capture Metastatic Breast Cancer Cells In Vivo. Cancer Res. Sep. 15, 2016;76(18):5209-18.
Ratzer, R. et al. Gene expression analysis of relapsing-remitting , primary progressive and secondary progressive multiple sclerosis. Mult Scler. Dec. 2013;19(14):1841-8.

(56) References Cited

OTHER PUBLICATIONS

Riveros, C. et al. A Transcription Factor Map as Revealed by a Genome-Wide Gene Expression Analysis of Whole-Blood mRNA Transcriptome in Multiple Sclerosis. PLoS One. Dec. 1, 2010;5(12):e14176.

Rovaris, M. et al., Secondary progressive multiple sclerosis: Current knowledge and future challenges, Lancet Neurol. Lancet Neurol. Apr. 2006;5(4):343-54.

Rumble, A.K. et al. Neutrophil-related factors as biomarkers in EAE and MS, J Exp Med. Jan. 12, 2015;212(1):23-35.

Safari-Alighiarloo, N., et al. Network-based analysis of differentially expressed genes in cerebrospinal fluid ( CSF ) and blood reveals new candidate genes for multiple sclerosis. PeerJ. Dec. 22, 2016;4:e2775.

Shepard et al., Hydrogel design for supporting neurite outgrowth and promoting gene delivery to maximize neurite extension. Biotechnol Bioeng. Mar. 2012; 109(3):830-9.

Sospedra, M., R. Martin, Immunology of Multiple Sclerosis. Annu Rev Immunol. 2005;23:683-747.

Tuller et al. Common and specific signatures of gene expression and protein-protein interactions in autoimmune diseases. Genes Immun. Mar. 2013;14(2):67-82.

Vanderlugt, C. L. et al. Epitope Spreading in Immune-Mediated Diseases: Implications for Immunotherapy. Nat Rev Immunol. Feb. 2002;2(2):85-95.

Wingerchuk, et al. Disease modifying therapies for relapsing multiple sclerosis. BMJ. Aug. 22, 2016;354:13518.

Yan, Z., et al. Role of the JAK / STAT signaling pathway in regulation of innate immunity in neuroinflammatory diseases. Clin Immunol. Apr. 2018;189:4-13.

Zerhouni, E. Progress in Autoimmune Diseases Research Progress in Autoimmune Diseases Research, 2005.

* cited by examiner

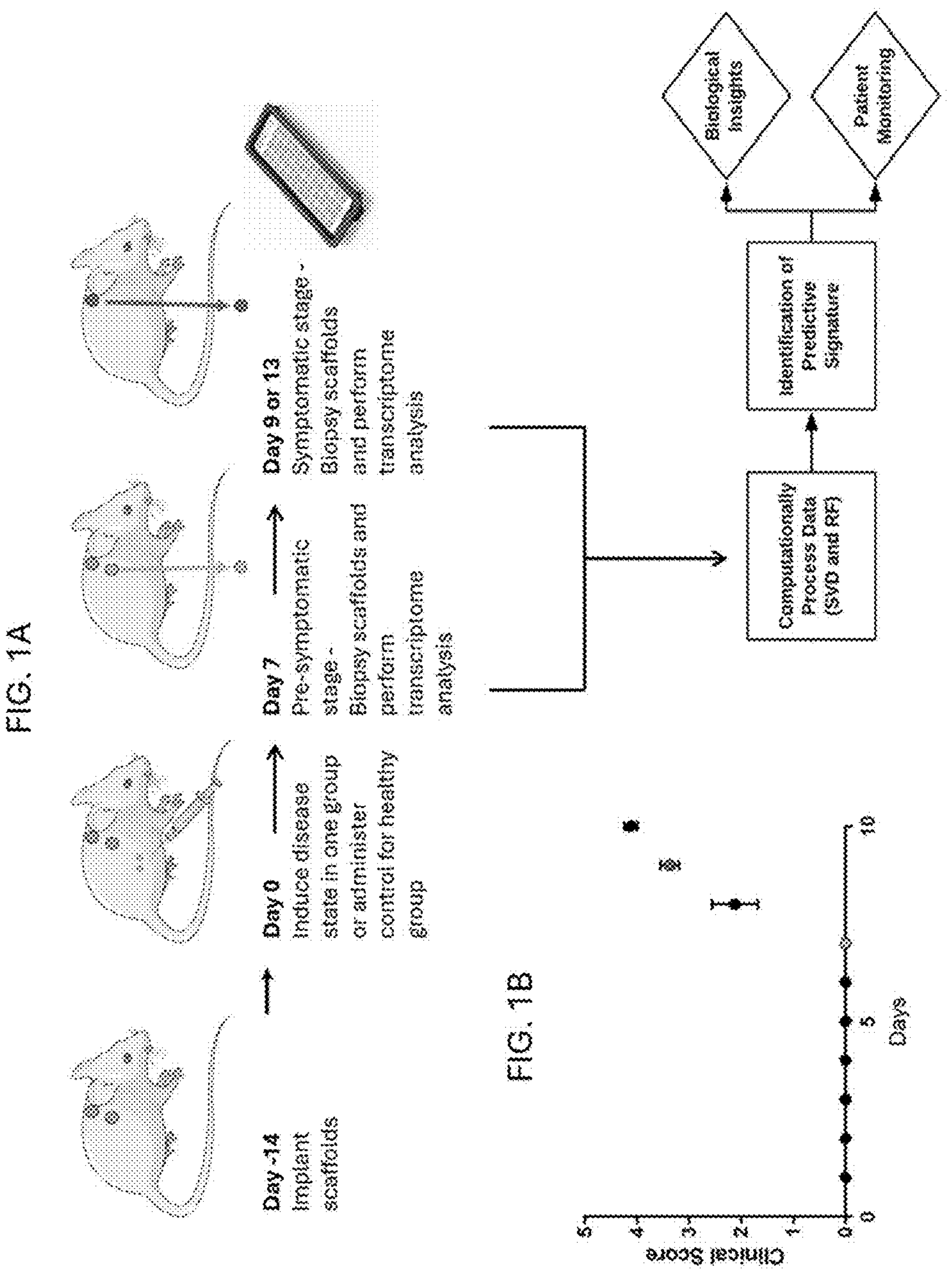
FIG. 1A
Day -14
Implant scaffolds
Day 0
Induce disease state in one group or administer control for healthy group
Day 7
Pre-symptomatic stage - Biopsy scaffolds and perform transcriptome analysis
Day 9 or 13
Symptomatic stage - Biopsy scaffolds and perform transcriptome analysis
Computationally Process Data (SVD and RF)
Identification of Predictive Signature
Biological Insights
Patient Monitoring
FIG. 1B
Clinical Score
Days
0
5
10
0
1
2
3
4
5

Random Forest Prediction (EAE Probability %)
100
80
60
40
20
0
0
0.2
0.4
0.6
0.8
1
SVD Gene Expression Score (Arb. Units)
OVA
EAE7
EAE9
CI HC
CI EAE
HC Gene Expression Score
1.2
1
0.8
0.6
0.4
0.2
0
0
1
2
3
4
Clinical Score Day After Biopsy Control = $OVA_{323-339}$ Ag = PLG-$PLP_{139-151}$

FIG. 14A

Diabetic

Pre-diabetic

Healthy

Blood Glucose mg/dL 260 240 220 200 180 160 140 120 100

Days Post Surgery 15 20 25 30 35 40

100
101
DISPLAY/
OUTPUT
DEVICE
140
INPUT
DEVICE(S)
142
102
CLIENT DEVICE
CPU
128
RAM
130
NONVOLATILE
MEMORY
132
134
136
138
112
Network
104
114
140
142
142
102
DATABASE
CLAIM DATA
BENCHMARK
DATA
OTHER DATA
108
122
124
126

FIG. 16A

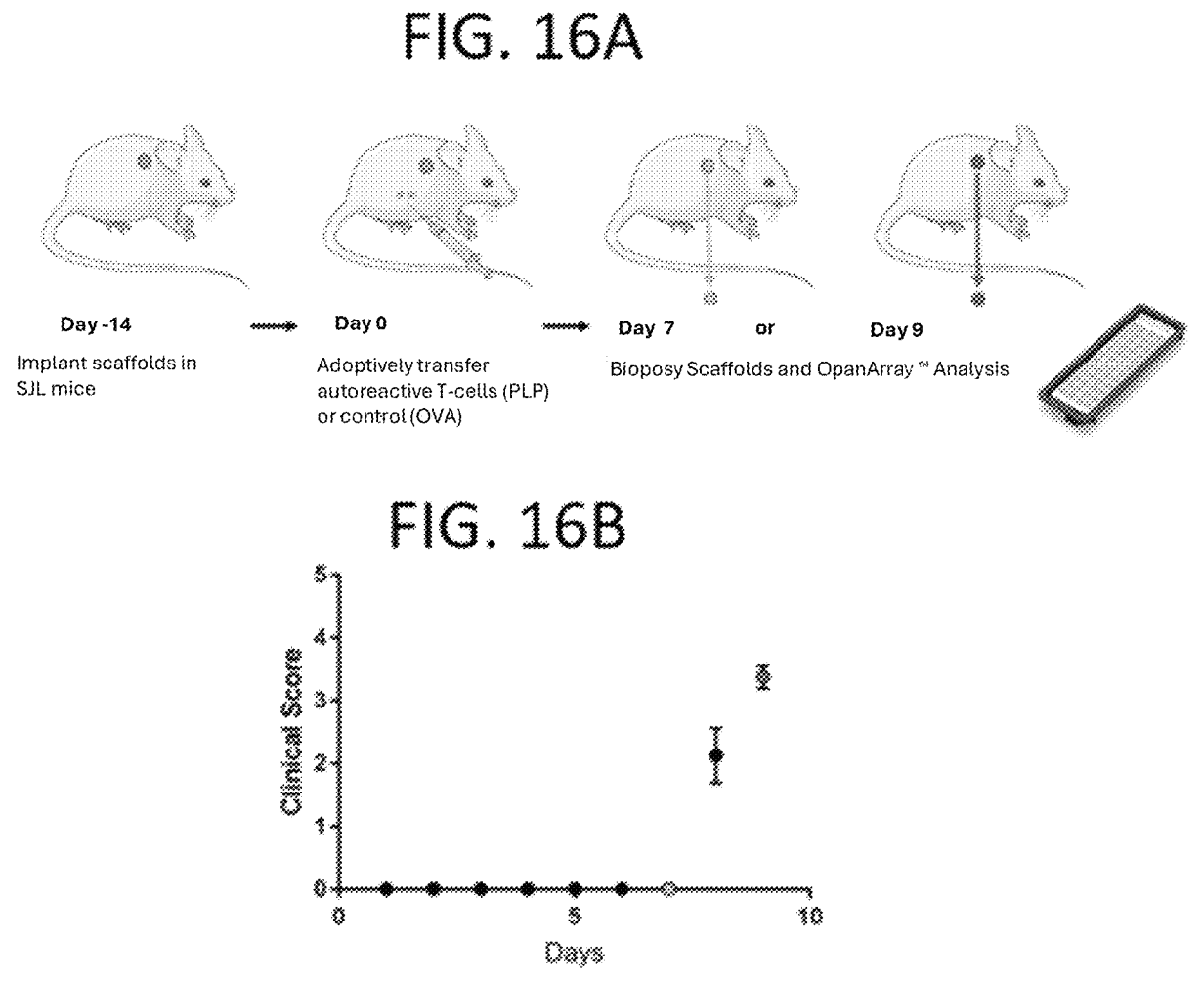

Day -14
Implant scaffolds in SJL mice

Day 0
Adoptively transfer autoreactive T-cells (PLP) or control (OVA)

Day 7 or Day 9
Biopoosy Scaffolds and OpanArray ™ Analysis

FIG. 16B

Clinical Score
0 1 2 3 4 5
Days
0 5 10

OVA
PLP
CD11b+ F4/80+
CD11c+ F4/80-
CD11b+ Gr-1hi Ly6C
Ly6C+ F4/80-
CD4+
CD8+
CD19+
CD49b+
Leukocytes (% of Live CD45+ cells)
40
30
20
10
0
*
Day 9

Fn1
Lif
Bdkrb1
Tnfrsf11b
Cfb
Olr1
Clec7a
Cxcl5
Ptgs2
Cxcl3
Il1f9
Il1b
Trem1
Cxcl2
S100a8
Cxcl1
Il6
Ereg
Vegfa
Cd163
Adrb2

Ereg
Lif
Tnfrsf11
Olr1
Cxcl5
Cxcl3
Il6
Vegfa
Cxcl1
Cxcl2
Cd163
Fn1
Cfb
Bdkrb1
Trem1
S100a9
Clec7
Il1b
Adrb2
Il1f9
Ptgs2

D7
D9
FC =±2
p = .05
-Log10 p Value
Log2 Fold Change
All OVA controls (OVA)
Day 7 Diseased
Day 9 Diseased Adrb2
Gene Expression
($log_2$ FC)

Bdkrb1

Cd163

Cfb
0.5
0
-0.5
-1
-1.5

Clec7a
0.2
0
-0.2
-0.4
-0.6
-0.8
-1
-1.2
-1.4
-1.6

Cxcl1
0.5
0
-0.5
-1
-1.5
-2
-2.5
-3
-3.5

Cxcl2

Cxcl3

Cxcl5
Gene Expression
(log2 FC)

Olr1

0.5
0
-0.5
-1
-1.5
-2
-2.5
-3
-3.5

*
**
Ptgs2

Gene Expression
($log_2$ FC)
0
-1
-2
-3
-4

*
**
S100a9

0
-1
-2
-3
-4

Bagged Tree Prediction (EAE Probability %)
SVD Gene Expression Score (Arb. Units)
Dex
PLPp
99.9% CI
OVA
EAE Sensitivity
1 - Specificity
SVD Train
BT Train
Combined
Random Sensitivity
1 - Specificity
SVD
BT
Combined
Random Sensitivity
1 - Specificity
SVD Treatment
BT Treatment
Combined
Random FIG 29 Cont'd
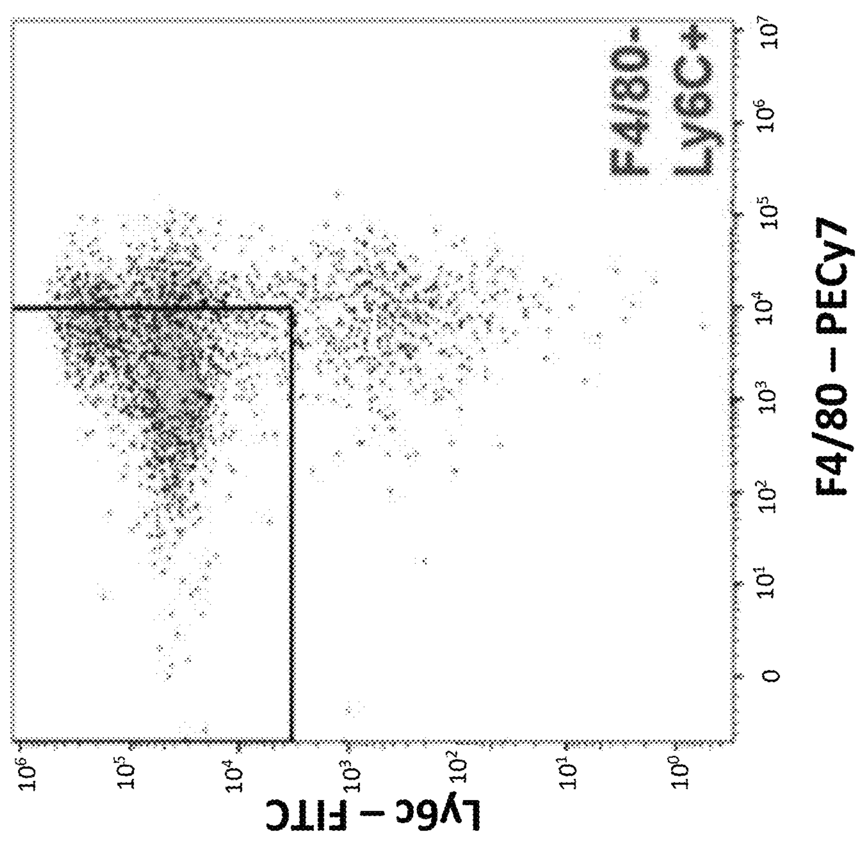
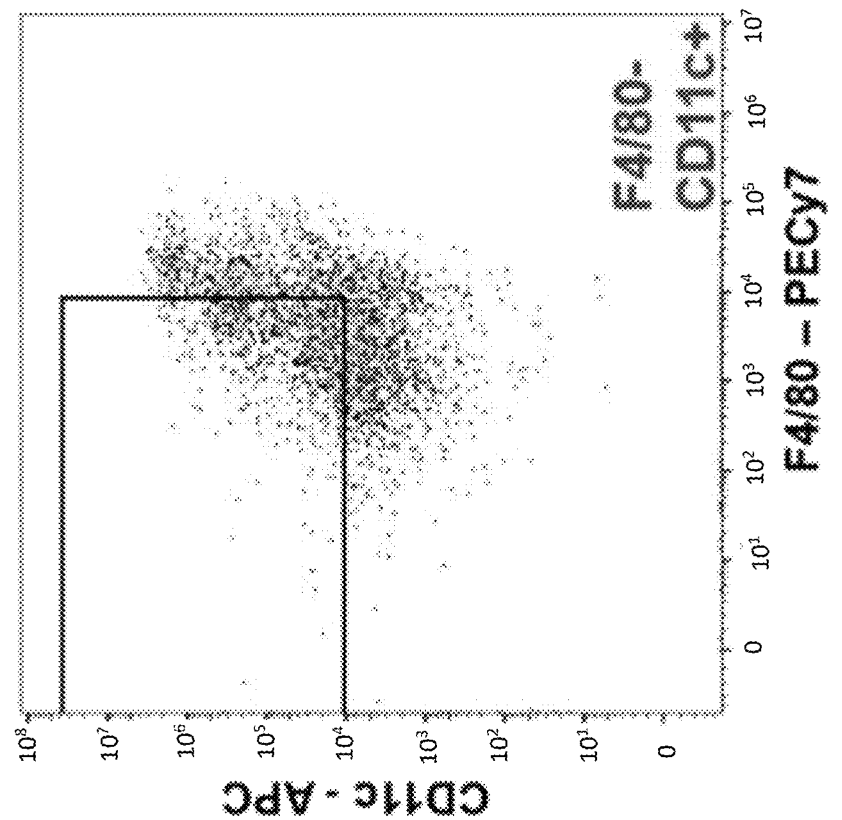

FIG 30 Cont'd
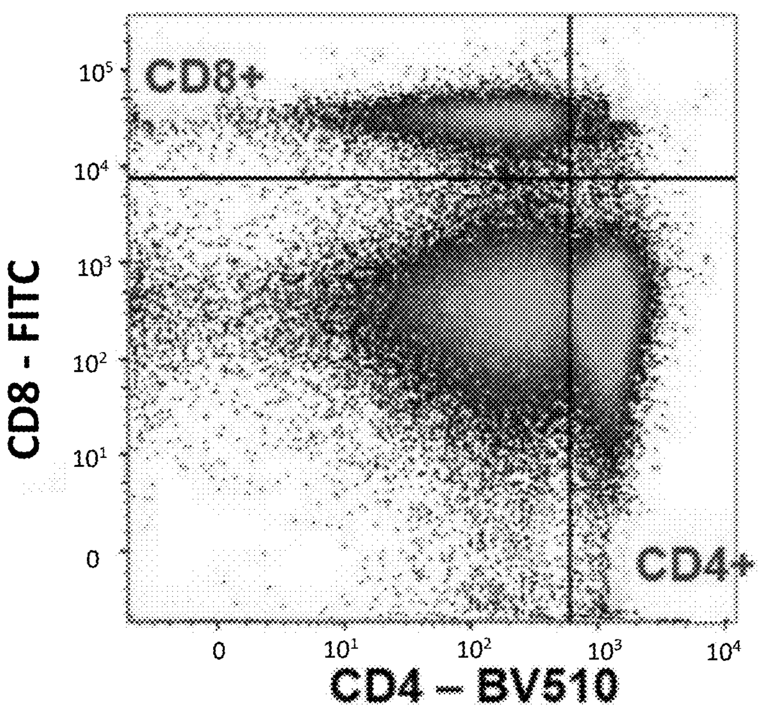
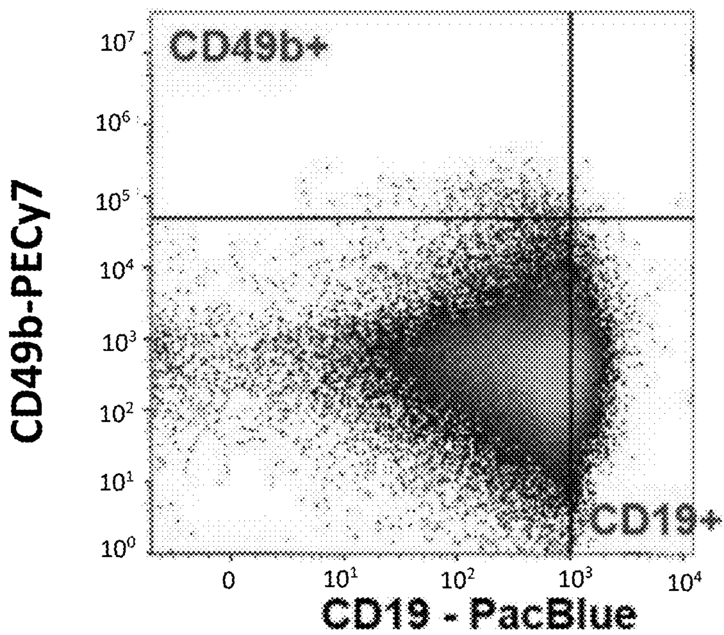

METHOD FOR MONITORING AUTOIMMUNE DISEASE

CROSS-REFERENCE TO RELATED APPLICATIONS

This application is a U.S. National Phase of International Application No. PCT/US2019/057293, filed Oct. 21, 2019, which claims priority to U.S. Provisional Application No. 62/748,366, filed on Oct. 19, 2018, the entire contents of which are incorporated herein by reference.

INCORPORATION BY REFERENCE OF MATERIAL SUBMITTED ELECTRONICALLY

Incorporated by reference in its entirety is a computer-readable nucleotide/amino acid sequence listing submitted concurrently herewith and identified as follows: 602,174 byte ASCII (Text) file named "53564A_Seqlisting.txt"; created on Oct. 21, 2019.

BACKGROUND

Autoimmune diseases are caused by a breakdown in self-tolerance, resulting in an immune response to self-antigens and eventual tissue damage. Autoimmune diseases effect nearly every organ, including the central nervous system (multiple sclerosis), endocrine system (type 1 diabetes), and skin (psoriasis), leading to a total disease prevalence in the United States of approximately 15-24 million patients, a number that is rapidly increasing [1]. Multiple sclerosis (MS) is a demyelinating disease with a worldwide prevalence of 2.1 million people. MS leads to a severe reduction in quality of life and patients with MS often suffer from paralysis or death, the etiology of which is unknown. Most patients (85%) who eventually develop MS first present with a clinically isolated syndrome (CIS), exhibiting symptoms commonly associated with demyelination, but do not meet the criteria for MS diagnosis [2]. Such patients are simply monitored for further symptomatic demyelinating events.

Upon developing MS, the patients fall into two main groups: either primary progressive MS (PPMS) (approx. 15%) or relapsing remitting MS (RRMS) (approx. 85%) [3]. Patients with PPMS present with multiple sclerosis that never remits, but instead exhibit a steady progression in disability. In contrast, patients with RRMS exhibit disease in which they experience serious clinical symptoms followed by remission and subsequent relapse. In these patients, remission may not fully recover function, resulting in some progression over time, in addition to the risk of transitioning to secondary progressive MS (SPMS), which most patients eventually will [4].

The ability to monitor disease progression of MS and treatment responsiveness using biomarkers has been an elusive goal, because a lack of adequate diagnostic and prognostic information is a major limitation in patient care [5-13]. The initial diagnosis of CIS is not enough for a patient to be considered as having MS, because not all CIS patients develop the disease [2,14]. This leads to monitoring of the patient for secondary episodes of demyelinating disease symptoms, but precision health approaches could enable the creation of next-generation diagnostics that could be implemented immediately after a CIS to alert physicians that treatment is necessary before full progression to MS. In the case of RRMS (the most frequent type), if disease could adequately be monitored and relapses predicted, drugs could likely intervene to prevent relapse and disease progression to SPMS, providing an opportunity in which a precision prognostic could have a tremendous impact [10,12]. Furthermore, many autoimmune diseases (e.g. MS, rheumatoid arthritis, ulcerative colitis) have an array of treatments that may or may not work for a particular patient, and patients must try many treatments before finding ones that mitigate their symptoms. This means that precision health and personalized medicine approaches that are effective in MS may find applicability in a number of conditions.

Thus, there is a need in the art for methods of monitoring autoimmune disease progression or regression in a subject, for example, monitoring the stage (e.g., relapse, remission) of the autoimmune disease or monitoring treatment response. There also is a need in the art for methods of detecting or diagnosing an autoimmune disease in a subject, e.g., before disease onset, or diagnosing RRMS vs SPMS vs PPMS.

SUMMARY

The present disclosure is directed generally to synthetic scaffolds that, upon implantation in a subject, e.g., in the subcutaneous space or fat pad, lead to in vivo events (e.g., a foreign body response) that result in the creation of a niche in the subject at the implantation site. Without being bound to a particular theory, the niche is representative of the subject's health status with regard to a disease, e.g., an autoimmune disease, or lack thereof. The niche may be biopsied, and the analysis of the biopsied sample allows for the disease diagnosis and/or prognosis, in addition to treatment monitoring. Presented herein are data demonstrating that expression profiles, such as, for example, gene expression profiles, RNA expression profiles, and/or protein expression profiles of cells captured at or biopsied from the niche change as a function of disease progression, e.g., progression from pre-symptomatic disease to symptomatic disease. Data are presented here that additionally support that gene expression profiles, RNA expression profiles, and/or protein expression profiles of cells captured at or biopsied from the niche change as a function of disease regression, e.g., regression achieved by treatment.

Without being bound to any particular theory, these expression profiles of the cells of the niche are representative of a subject's status with regard to autoimmune disease and the potential, risk, or likelihood therefor, and therefore, such expression profiles allow for early diagnosis or detection of autoimmune disease. For example, such profiles may be used to monitor a subject before, during or after the onset of the autoimmune disease or to monitor a subject before, during or after relapse of the autoimmune disease. Because the expression profiles represent the subject's status in this regard, the expression profiles may be used to determine a subject's treatment or therapy, e.g., determine a subject's need for treatment or therapy for (onset or relapse of) the autoimmune disease. In related aspects, the expression profiles may also be useful for determining the efficacy of a treatment administered to or performed on a subject receiving such treatment. In yet other related aspects, the expression profiles may be used in methods of preventing or delaying the onset or relapse of the autoimmune disease or reducing the frequency of relapse of the autoimmune disease.

Accordingly, the present disclosure provides a method of detecting or diagnosing an autoimmune disease (AID) in a subject. In exemplary embodiments, the method comprises measuring a level of expression of a gene, an RNA, or a protein, or a combination thereof, in a sample obtained from a niche at the implantation site of a synthetic scaffold in the subject, wherein the measured expression level of the gene, RNA or protein in the sample is compared to a control level. In exemplary aspects, the method leads to the diagnosis of a stage of the autoimmune disease, e.g., CIS, RRMS, SPMS, or PPMS, disease onset, relapse or remission.

The present disclosure also provides a method of monitoring the progression or regression or an AID in a subject. In exemplary embodiments, the method comprises measuring a level of expression of a gene, an RNA, or a protein, or a combination thereof, in a sample obtained from a niche at the implantation site of a synthetic scaffold in the subject at a first time point and at a second time point, wherein the expression level measured at the first time point is compared to the expression level measured at the second time point, wherein the difference in the level of expression at the second time point relative to the level of expression at the first time point is indicative of progression or regression of the AID.

Provided herein are methods of monitoring the stage of an autoimmune disease. The method in exemplary embodiments comprises measuring a level of expression of a gene, an RNA, or a protein, or a combination thereof, in a sample obtained from a niche at the implantation site of a synthetic scaffold in the subject at a first time point and at a second time point, wherein the expression level measured at the first time point is compared to the expression level measured at the second time point, wherein the difference in the level of expression at the second time point relative to the level of expression at the first time point is indicative of the stage of the AID. In exemplary aspects, the method leads to the identification of the AID stage as pre-symptomatic, symptomatic, or as in remission or in relapse, or as CIS, RRMS, SPMS, or PPMS. Alternatively, the method leads to the identification of the AID stage as pre-diabetic or diabetic.

Further provided is a method of determining treatment for a subject with an AID, comprising monitoring the progression, regression, or stage of the AID in the subject in accordance with the presently disclosed method of monitoring or the presently disclosed method of diagnosing the subject and determining the treatment based on the stage of the AID or diagnosis. In exemplary instances, the method of determining treatment for a subject with an AID comprises (a) measuring a level of expression of a gene, an RNA, or a protein, or a combination thereof, in a sample obtained from a niche at the implantation site of a synthetic scaffold in the subject, wherein the measured expression level of the gene, RNA or protein in the sample is compared to a control level and (b) determining the treatment based on (a). In exemplary instances, the method of determining treatment for a subject with an AID comprises (a) measuring a level of expression of a gene, an RNA, or a protein, or a combination thereof, in a sample obtained from a niche at the implantation site of a synthetic scaffold in the subject at a first time point and at a second time point, wherein the expression level measured at the first time point is compared to the expression level measured at the second time point, wherein the difference in the level of expression at the second time point relative to the level of expression at the first time point is indicative of progression or regression or stage of the AID and (b) determining the treatment based on (a).

A method of determining efficacy of an AID treatment in a subject is furthermore provided herein. In exemplary embodiments, the method comprises monitoring progression, regression, or stage of the AID in a subject in accordance with the presently disclosed method of monitoring, wherein the first time point occurs before treatment and the second time point occurs after treatment. In exemplary instances, the method of determining efficacy of an AID treatment in a subject comprises (a) monitoring progression, regression, or stage of the AID in a subject by measuring a level of expression of a gene, an RNA, or a protein, or a combination thereof, in a sample obtained from a niche at the implantation site of a synthetic scaffold in the subject at a first time point and at a second time point, wherein the first time point occurs before treatment and the second time point occurs after treatment, wherein, the AID treatment is effective in the subject, when regression of the AID from the first time point to the second time point is observed, wherein the AID treatment is ineffective in the subject, when a lack of regression or progression of the AID from the first time point to the second time point is observed.

The present disclosure additionally provides a method of treating an AID in a subject. In exemplary embodiments, the method comprises determining treatment for an AID for a subject in accordance with the presently disclosed method of determining treatment, and administering the determined treatment to the subject. In exemplary instances, the method of determining treatment for a subject with an AID comprises (a) measuring a level of expression of a gene, an RNA, or a protein, or a combination thereof, in a sample obtained from a niche at the implantation site of a synthetic scaffold in the subject, wherein the measured expression level of the gene, RNA or protein in the sample is compared to a control level and (b) determining the treatment based on (a). In exemplary instances, the method of determining treatment for a subject with an AID comprises (a) measuring a level of expression of a gene, an RNA, or a protein, or a combination thereof, in a sample obtained from a niche at the implantation site of a synthetic scaffold in the subject at a first time point and at a second time point, wherein the expression level measured at the first time point is compared to the expression level measured at the second time point, wherein the difference in the level of expression at the second time point relative to the level of expression at the first time point is indicative of progression or regression or stage of the AID and (b) determining the treatment based on (a).

Additional methods of treating a subject are further provided herein. In exemplary embodiments, the method comprises administering plasmapheresis (plasma exchange) to a subject having a high score. In exemplary embodiments, the method comprises administering corticosteroids to a subject having an intermediate score. In exemplary embodiments, the method comprises monitoring the AID in the subject having a low score. Additionally or alternatively, the score method may indicate that a change in therapy is needed for patients at risk of a change in disease.

In exemplary embodiments, the method comprises administering higher doses of therapy or more intensive immunosuppressants to a subject having a high score. In exemplary embodiments, the method comprises administering lower therapeutic doses or therapies that may be less efficacious, but also have fewer risks to a subject having an intermediate score.

Further provided herein are systems comprising: a processor; a memory device coupled to the processor, and machine readable instructions stored on the memory device. Computer-readable storage media having stored thereon machine-readable instructions executable by a processor and methods implemented by a processor in a computer are additionally provided herein.

BRIEF DESCRIPTION OF THE DRAWINGS

FIG. 1A is an illustration of the experimental procedure carried out in multiple studies.

FIG. 1B is a graph of clinical score plotted as a function of time.

FIG. 14A is a graph of blood glucose levels (mg/dL) as a function of time (days) post-surgery. The blood glucose levels of diabetic, pre-diabetic and healthy subjects are delineated.

FIGS. 16A-16H demonstrate IN gene expression changes enables scoring and segmenting of diseased and healthy during EAE onset. FIG. 16A) SJL mice were implanted with PCL scaffolds 14 days prior to adoptive transfer of T cells reactive to either $PLP_{139-151}$ (EAE) or $OVA_{323-339}$ (control). INs were subsequently removed at an asymptomatic (7 day) or symptomatic (9 day) time point for analysis via high-throughput qPCR (OpenArray). FIG. 16B) Clinical scores of the mice at each time point demonstrate that no mice displayed symptoms of EAE at day 7 post-implantation, but mice were symptomatic by day 9. FIG. 16C) Flow cytometry for immune cell surface markers demonstrates minor differences between OVA and PLP at day 9. Data are presented as mean+SEM. Statistical analysis performed by student's t-test, asterisk indicates change from control (*$p=0.038$). n=7 (PLP) or 8 (OVA) mice. FIG. 16D) Heatmap and hierarchical clustering of 21 identified genes of interest, expression levels standardized by gene (n=8 per condition, 4 at day 7, 4 at day 9). FIG. 16E) Radar plot demonstrates altered gene expression (as $\log_2$ FC) for signature genes in pre-symptomatic and symptomatic when compared to time-matched OVA controls, with a similar pattern at both time points. FIG. 16F) Plot of the bagged tree (BT) prediction score versus SVD indicates separation between groups. Black lines indicate 99.9% confidence intervals for pooled diseased or control mice. Filled ovals indicate mean (centroid) and standard error of the mean for each indicated group. Each point is from an individual mouse and increasing point size indicates sicker mice (as an average of the day of explant and day after). FIG. 16G) Heatmap and hierarchical clustering signature genes from blood (expression levels standardized by gene) indicate no clear clustering of controls from diseased samples, n=5 per condition. FIG. 16H) A radar plot of gene expression signature (as $\log_2$FC) from blood during symptomatic onset clearly does not show the same patterns as that of the IN. Mouse cartoon from Servier image bank, servier.com/Powerpoint-image-bank.

FIGS. 17A-17B) Radar plots demonstrate similar gene expression (as $\log_2$FC) for signature genes in remission when compared to time-matched controls (a), but altered expression in relapse (b). FIG. 17C) Plot of BT score versus SVD indicates no separation between healthy and remitting mice, but separation between relapse and healthy. Black lines indicate historic (from disease onset data) 99.9% confidence intervals for pooled diseased or control mice. Each point indicates a single mouse. FIGS. 17D-17F) SVD score ($F(3,19)=5.391$, $p=0.0074$) (d), BT score ($F(3,19)=9.421$, $p=0.0005$) (e), and a combined metric ($F(3,19)=6.504$, $p=0.0033$) (f) plotted versus time (left y-axis, black lines) and corresponding clinical scores at each time point (right axis, points) indicates only the remission t.p. (d21) is significantly different from peak disease (d9). Data are presented as mean+SEM. A one-way ANOVA was used to compare scores over time for EAE mice. A Bonferroni-corrected post-hoc multiple comparisons test was used to compare each time point to symptomatic disease onset (d9). (n=9 OVA at d21, n=5 OVA at d28, n=11 PLP at d21, n=4 PLP at d28).

FIG. 18A) Radar plot demonstrating similar gene expression (as $\log_2$FC) for signature genes in EAE mice treated with PLP loaded particles when compared to time-matched controls treated with particles, but altered expression in EAE mice treated with control (OVA) particles. FIG. 18B) Plot of BT score versus SVD indicates no separation between healthy mice treated with control particles and EAE mice treated with PLP particles (responders to treatment), but a clear separation in EAE mice treated with OVA particles (nonresponders/control treatment). Black lines indicate historic (from disease onset data) 99.9% confidence intervals for pooled diseased or control mice. Each point indicates a single mouse. Another experiment was designed to test if early detection of disease by INs could enable proactive treatment to prevent the development of EAE. Seven days post-transfer INs were explanted and mice proactively treated with either an I.V. injection of 2.5 mg PLG nanoparticles encapsulating $PLP_{139-151}$ or daily I.P. injections of 5 mg/kg dexamethasone. FIG. 18C) Mean clinical scores of the mice at each time point demonstrate that both pre-emptive treatments reduce disease severity when compared to an untreated control. A two-way ANOVA was used to compare scores ($F(2, 11)=5.422$, $p=0.0230$). A Dunnett's multiple comparisons test was used to compare each treatment to the untreated control at each time point. (n=6 untreated and 4 treated, $^{}p\leq0.0012$ and $^{*}p\leq0.0002$ on days 9-11). Arrows indicate dexamethasone administration and particle administration.

FIG. 19A) Heatmap and hierarchical clustering of gene expression from entire OpenArray panel (n=8 per condition, 4 at day 7, 4 at day 9). FIG. 19B) Volcano plot of OpenArray data. Lines indicate a fold change of ±2 and p=0.05. In total, 130 genes are significantly differentially expressed at the INs between healthy and diseased mice.

FIG. 21A)-21C) Gene expression data was used to train a bootstrap aggregated (bagged) decision tree ensemble to predict the probability that any given mouse was diseased ($F(1,12)=26.84$, #p=0.0002) FIG. 21B) An unsupervised dimensionality reduction technique (singular value decomposition-SVD) was used to reduce the gene expression of the 21-gene signature to a score ($F(1,12)=85.69$, #p=8.19e-07). Two-way ANOVA was used to compare pooled OVA controls vs diseased mice. A Bonferroni-corrected post-hoc multiple comparisons test was used to compare diseased to time matched controls (*p<0.05, p<0.0005). FIG. 21**C) Three principle components of SVD plotted in a 3D scatter plot. The single SVD scores were computed by calculating the Euclidean distance from the OVA control centroid to any given point (each point represents an independent mouse).

FIG. 22 shows INs isolated from healthy mice have similar scores to OVA controls. Plot of the bagged tree (BT) prediction score versus SVD in which points represent INs isolated from healthy mice (no adoptively transferred cells), mice that received OVA adoptive transfers and PLP adoptive transfers. Black lines indicate 99.9% confidence intervals for pooled diseased or control mice. Filled ovals indicate mean (centroid) and standard error of the mean for each indicated group. Clearly, the signature scores for healthy mice and OVA controls are similar.

FIG. 24A) H&E stains indicate a normal FBR for a porous material in both OVA and PLP conditions demonstrating immune infiltrate, foreign body giant cell (FBGC) formation, and tissue ingrowth. FIG. 24B) Flow cytometry for immune cell surface markers demonstrates minor differences between OVA and PLP, but little change in the cell populations within the INs over time. Data are presented as mean+SEM. Statistical analysis performed by student's t-test at individual time points, asterisks indicate change from control (*p<0.05, **p<0.01). n=7-8 mice per time point.

FIGS. 25A-25-B show dynamics of EAE disease state are detectable in IN. FIG. 25A) SJL mice were implanted with PCL INs 14 days prior to adoptive transfer of T cells reactive to either $PLP_{139-151}$ (EAE) or $OVA_{323-339}$ (control). INs were subsequently removed at a remission (21 day) or relapse (28 day) time point for analysis via qPCR. A second adoptive transfer of cells reactive against another immunodominant epitope (to mimic epitope spreading in relapse) was performed on day 23 to induce relapse.

FIG. 26A) SJL mice were implanted with PCL INs 14 days prior to adoptive transfer of T cells reactive to either $PLP_{139-151}$ (EAE) or $OVA_{323-339}$ (control). Nanoparticle treatments were injected intravenously on day 2 and INs subsequently removed on day 9 for analysis via qPCR. Analysis of gene expression by the trained bagged tree ($F(2,15)=34.2$, p=2.6e-06) (FIG. 26B) and SVD ($F(2,15)=15.96$, p=0.0002) (FIG. 26C) demonstrated significantly higher scores for mice that received ineffective treatments (and developed symptoms of EAE). One-way ANOVA and a Bonferroni-corrected post-hoc multiple comparisons test was used to compare each group (p<0.0005, different from both control and PLPp treated). FIG. 26D) Mean clinical scores of the mice at each time point demonstrate only the OVA loaded particle treatment demonstrating significantly increased scores from control. A Kruskal-Wallis test (Kruskal-Wallis statistic=11.69, p=0.0002) was used to compare scores for EAE mice and a Dunn's multiple comparisons test was used to compare each group to the OVA control (p=0.0016).

DETAILED DESCRIPTION

Autoimmune Diseases

Figure 2A:
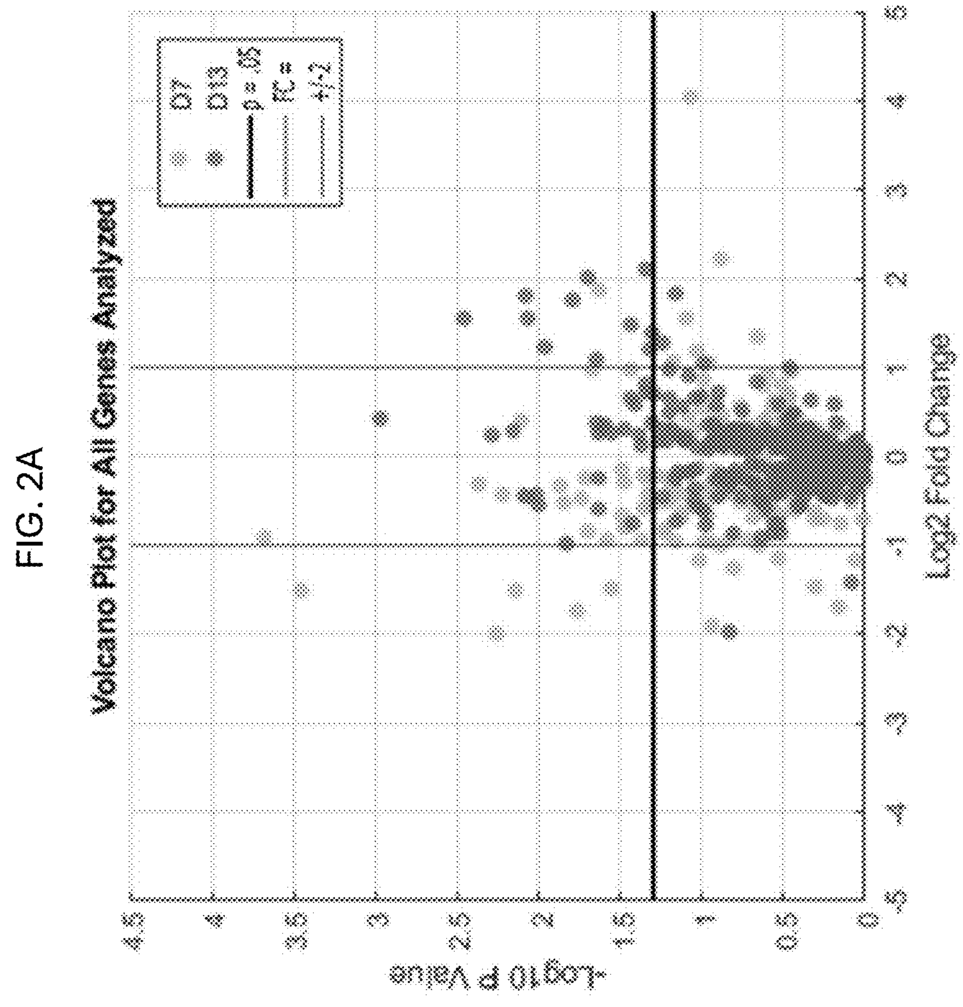
FIG. 2A is a volcano plot demonstrating that EAE induced changes in the transcriptome within the niche created at the scaffold, relative to the control.

The present disclosure provides methods relating to a subject's status (stage of disease, progression, regression, etc.) with regard to an autoimmune disease. As used herein, the term "autoimmune disease" or "AID" refers to a condition in which a subject's immune system attacks one or more parts of the subject's body. The AID in various aspects is diabetes, e.g., type 1 diabetes, rheumatoid arthritis, osteoarthritis, psoriasis, psoriatic arthritis, multiple sclerosis, systemic lupus erythematosus (SLE, lupus), inflammatory bowel disease (IBD, e.g., Crohn's disease, ulcerative colitis), Addison's disease, Graves' disease, Sjogren's syndrome, Hashimoto's thyroiditis, Myasthenia gravis, vasculitis, pernicious anemia, or celiac disease. In exemplary aspects, the autoimmune disease is MS and the MS is relapsing-remitting MS (RRMS), primary progressive MS (PPMS), secondary progressive MS (SPMS), or progressive relapsing MS (PRMS).

The AID may have different stages or subtypes. In exemplary aspects, the AID is diabetes and, in particular aspects, the diabetes is Type 1 diabetes. In various instances, the AID is RRMS and the RRMS is in a stage of remission or a stage immediately preceding remission. Alternatively, the RRMS is in a stage of relapse or a stage immediately preceding relapse.

Autoimmune Disease Detection, Diagnosis and Monitoring

The present disclosure provides a method of detecting or diagnosing an autoimmune disease (AID), or a predisposition thereto, in a subject. In exemplary embodiments, the method comprises measuring a level of expression of a gene, an RNA, or a protein, or a combination thereof, in a sample obtained from a niche at the implantation site of a synthetic scaffold in the subject, wherein the measured expression level of the gene, RNA or protein in the sample is compared to a control level. In exemplary aspects, the method leads to the diagnosis of a type or stage of the AID (e.g., status of the AID). For example, the method of diagnosing MS in a subject is a method of diagnosing the subject with CIS, RRMS, SPMS, or PPMS. In various instances, the method is a method of diagnosing Type 1 diabetes as pre-diabetic or diabetic. In various instances, the method is a method of diagnosing the AID as symptomatic or pre-symptomatic. In instances, where, for example, the subject has never been diagnosed with the AID, the method may be considered as a method of detecting the AID or predicting the onset of the AID or detecting a pre-disposition to the AID. Additional outcomes of AID determination or diagnosis are described herein.

The present disclosure also provides a method of monitoring the progression or regression or an AID in a subject. In exemplary embodiments, the method comprises measuring a level of expression of a gene, an RNA, or a protein, or a combination thereof, in a sample obtained from a niche at the implantation site of a synthetic scaffold in the subject at a first time point and at a second time point, wherein the expression level measured at the first time point is compared to the expression level measured at the second time point, wherein the difference in the level of expression at the second time point relative to the level of expression at the first time point is indicative of progression or regression of the AID. The progression or regression of the AID may be progression or regression over time with or without treatment. For example, the progression or regression may be the relapse-remission cycling of a subject with RRMS. Accordingly, the presently disclosed method of monitoring is a method of monitoring the relapses or remissions of RRMS in a subject.

Provided herein are methods of monitoring an autoimmune disease in a subject. The method in exemplary embodiments comprises measuring a level of expression of a gene, an RNA, or a protein, or a combination thereof, in a sample obtained from a niche at the implantation site of a synthetic scaffold in the subject at a first time point and at a second time point, wherein the expression level measured at the first time point is compared to the expression level measured at the second time point, wherein the difference in the level of expression at the second time point relative to the level of expression at the first time point is indicative of the stage of the AID. In exemplary aspects, the method leads to the identification of the AID stage as pre-symptomatic, symptomatic, or as progression from RRMS to SPMS. Alternatively, the method leads to the identification of the AID stage as pre-diabetic or diabetic.

In exemplary embodiments, the subject is taking treatment for the AID. The present disclosure in various aspects provides a method of determining efficacy of an AID treatment in a subject. In exemplary embodiments, the method comprises monitoring progression, regression, or stage of the AID in a subject in accordance with the presently disclosed method of monitoring, wherein the first time point occurs before treatment and the second time point occurs after treatment. In exemplary instances, the method of determining efficacy of an AID treatment in a subject comprises (a) monitoring progression, regression, or stage of the AID in a subject by measuring a level of expression of a gene, an RNA, or a protein, or a combination thereof, in a sample obtained from a niche at the implantation site of a synthetic scaffold in the subject at a first time point and at a second time point, wherein the first time point occurs before treatment and the second time point occurs after treatment, wherein, the AID treatment is effective in the subject, when regression of the AID from the first time point to the second time point is observed, wherein the AID treatment is ineffective in the subject, when a lack of regression or progression of the AID from the first time point to the second time point is observed. In exemplary aspects, the method determines that the AID treatment taken by the subject is ineffective or not sufficiently effective. In exemplary aspects, the method determines that the AID treatment needs to increase. For purposes herein, an AID treatment may be described in terms of the AID medication(s) and the doses (and frequency) for each. To increase an AID treatment means to increase the dose(s) and/or frequency or frequencies of the AID medication or combination of AID medications, or to add one or more AID medications to the existing AID medication(s) of the treatment. In exemplary aspects, increasing an AID treatment means increasing the level of intensity of the AID treatment. In exemplary aspects, the method determines that the AID treatment taken by the subject is effective, and in exemplary aspects, the method determines that the subject should continue the AID treatment. To continue an AID treatment refers to remaining on the same AID medication or combination of AID medications at the prescribed dose(s) and frequency or frequencies. In exemplary aspects, the method determines that the AID treatment taken by the subject is effective, and in exemplary aspects, the method determines that the AID treatment needs to decrease. To decrease an AID treatment means to reduce the dose(s) and/or frequency or frequencies of the AID medication or combination of AID medications, or to remove one or more AID medications from the combination of AID medications. In exemplary aspects, decreasing an AID treatment means decreasing the level of intensity of the AID treatment. In exemplary aspects, the method determines that the subject should discontinue the AID treatment. To discontinue an AID treatment means to stop an AID medication or combination of AID medications at the prescribed dose(s) and frequency or frequencies. Discontinuing an AID treatment may be the discontinuation of all AID treatments (e.g., AID medications) or may be the stopping of one AID treatment and the starting of a different or modified AID treatment.

In exemplary embodiments, the subject is not taking treatment for the AID. The present disclosure in various aspects provides a method of determining treatment for a subject with an AID based on the outcome of the diagnosis or monitoring of the AID. In various aspects, the method of determining treatment for a subject with an AID comprises monitoring the progression, regression, or stage of the AID in the subject in accordance with the presently disclosed method of monitoring or the presently disclosed method of diagnosing the subject and determining the treatment based on the stage of the AID or diagnosis.

In exemplary instances, the methods comprise measuring the expression level of at least 2, 3, 4, 5 or more genes, at least 2, 3, 4, 5 or more RNA, and/or at least 2, 3, 4, 5 or more proteins in the sample. In exemplary instances, the methods comprise measuring the expression level of at least 10, 15, 20 or more genes, at least 10, 15, 20 or more RNA, and/or at least 10, 15, 20 or more proteins in the sample. In exemplary instances, the methods comprise measuring the expression level of at least 50, 100, 200 or more genes, at least 50, 100, 200 or more RNA, and/or at least 50, 100, 200 or more proteins in the sample. In exemplary instances, the methods comprise measuring the expression level of a plurality of different genes, a plurality of RNA, and/or a plurality of proteins.

In exemplary aspects, the expression levels of the genes, RNA, and/or proteins are processed through an algorithm to obtain a single metric or single score of gene expression, RNA expression, or protein expression. In exemplary aspects, the expression levels are normalized to housekeeping gene expression levels. In exemplary aspects, the expression levels are processed through singular value decomposition, dynamic mode decomposition, principle component analysis, fisher linear discriminant, or linear combination. In exemplary aspects, the expression levels of the genes, RNA, and/or proteins (optionally normalized to housekeeping gene expression levels) or the single metric or single score is processed through a machine learning algorithm to obtain a score of prediction of disease state, e.g., a % chance of attaining a diseased state. In exemplary aspects, the metric of gene expression, RNA expression, or protein expression is combined with the prediction score to obtain a graphical or numerical output, which may be used as a control (or a panel of controls) against which the measured levels are compared.

Treatment Methods

The present disclosure additionally provides a method of treating an AID in a subject. In exemplary embodiments, the method comprises determining treatment for an AID for a subject in accordance with the presently disclosed method of determining treatment, and administering the determined treatment to the subject. In exemplary instances, the method of determining treatment for a subject with an AID comprises (a) measuring a level of expression of a gene, an RNA, or a protein, or a combination thereof, in a sample obtained from a niche at the implantation site of a synthetic scaffold in the subject, wherein the measured expression level of the gene, RNA or protein in the sample is compared to a control level and (b) determining the treatment based on (a). In exemplary instances, the method of determining treatment for a subject with an AID comprises (a) measuring a level of expression of a gene, an RNA, or a protein, or a combination thereof, in a sample obtained from a niche at the implantation site of a synthetic scaffold in the subject at a first time point and at a second time point, wherein the expression level measured at the first time point is compared to the expression level measured at the second time point, wherein the difference in the level of expression at the second time point relative to the level of expression at the first time point is indicative of progression or regression or stage of the AID and (b) determining the treatment based on (a).

Additional methods of treating a subject are further provided herein. In exemplary embodiments, the method comprises administering plasmapheresis (plasma exchange) to a subject having a high score. In exemplary embodiments, the method comprises administering corticosteroids to a subject having an intermediate score. In exemplary embodiments, the method comprises monitoring the AID in the subject having a low score.

The present disclosure also provides a method of treating a subject having a high combined score of AID status, comprising administering to the subject an autoimmune disease (AID) treatment comprising plasmapheresis, corticosteroids, Alemtuzumab, fingolimod, IFN-beta, natalizumab, glatiramer acetate, ocrelizumab, dimethyl fumarate, teriflunomide, or mitoxantrone, or a combination thereof, wherein the high combined score of AID status was determined by measuring a level of expression of a gene, an RNA, or a protein, or a combination thereof, in a sample obtained from a niche at the implantation site of a synthetic scaffold in the subject.

A method of treating a subject having an intermediate combined score of AID status is further provided. In exemplary instances, the method comprises administering to the subject an autoimmune disease (AID) treatment comprising corticosteroids or another standard of care that is meant to limit neuroinflammation, wherein the intermediate combined score of AID status was determined by measuring a level of expression of a gene, an RNA, or a protein, or a combination thereof, in a sample obtained from a niche at the implantation site of a synthetic scaffold in the subject.

As used herein, the term "treat," as well as words related thereto, do not necessarily imply 100% or complete treatment. Rather, there are varying degrees of treatment of which one of ordinary skill in the art recognizes as having a potential benefit or therapeutic effect. In this respect, the methods of treating an autoimmune disease of the present disclosure can provide any amount or any level of treatment. Furthermore, the treatment provided by the method of the present disclosure can include treatment of one or more conditions or symptoms or signs of the cancer being treated. Also, the treatment provided by the methods of the present disclosure can encompass slowing the progression of the AID, slowing the onset of the AID, or slowing the frequency at which relapse of the AID occurs. For example, the methods can treat the AID by virtue of suppressing the T cell activity or an immune response against the self-antigen of the AID, reducing relapse intensity or frequency or length of time, increasing remission intensity or frequency or length of time, and the like. In exemplary aspects, the methods treat by way of delaying the onset or recurrence of relapse of the AID by at least 1 day, 2 days, 4 days, 6 days, 8 days, 10 days, 15 days, 30 days, two months, 3 months, 4 months, 6 months, 1 year, 2 years, 3 years, 4 years, or more.

The present disclosure provides methods of prophylactically treating (i.e., preventing) or delaying the onset of the AID or relapse of the AID. In exemplary embodiments, the methods comprise measuring a level of expression of a gene, an RNA, or a protein, or a combination thereof, in a sample obtained from a niche in the subject, wherein the measured expression level of the gene, RNA, or protein in the sample is compared to a control level, and administering an AID treatment to the subject, based on the measured level of expression.

In exemplary instances, the methods comprise measuring the expression level of at least 2, 3, 4, 5 or more genes, at least 2, 3, 4, 5 or more RNA, and/or at least 2, 3, 4, 5 or more proteins in the sample. In exemplary instances, the methods comprise measuring the expression level of at least 10, 15, 20 or more genes, at least 10, 15, 20 or more RNA, and/or at least 10, 15, 20 or more proteins in the sample. In exemplary instances, the methods comprise measuring the expression level of at least 50, 100, 200 or more genes, at least 50, 100, 200 or more RNA, and/or at least 50, 100, 200 or more proteins in the sample. In exemplary instances, the methods comprise measuring the expression level of a plurality of different genes, a plurality of RNA, and/or a plurality of proteins. In exemplary instances, the methods comprise measuring the expression level of a plurality of different genes, a plurality of RNA, and/or a plurality of proteins. In exemplary aspects, the expression levels of the genes, RNA, and/or proteins are processed through an algorithm to obtain a single metric or single score of gene expression, RNA expression, or protein expression. In exemplary aspects, the expression levels are normalized to housekeeping gene expression levels. In exemplary aspects, the expression levels are processed through singular value decomposition, dynamic mode decomposition, principle component analysis, fisher linear discriminant, or linear combination. In exemplary aspects, the expression levels of the genes, RNA, and/or proteins (optionally normalized to housekeeping gene expression levels) or the single metric or single score is processed through a machine learning algorithm to obtain a score of prediction of disease state, e.g., a % chance of attaining a diseased state. In exemplary aspects, the metric of gene expression, RNA expression, or protein expression is combined with the prediction score to obtain a graphical or numerical output, which may be used as a control (or a panel of controls) against which the measured levels are compared. Once the diagnosis of the (e.g., stage of the) AID is determined, an appropriate course of treatment for the subject may be determined and the treatment may be provided or administered to or prescribed for the subject.

As used herein, the term "treatment" is meant "therapeutic treatment" or "therapy" or "treatment regimen" or "treatment modality". As used herein, the term "autoimmune disease treatment" or "AID treatment" refers to any "therapeutic treatment" or "therapy" or "treatment regimen" or "treatment modality" purposed for improving the signs and symptoms of an AID. An The AID treatment in various aspects comprises an AID medication. In other aspects, the AID treatment comprises a combination of more than one AID medication. For purposes herein, an AID treatment may be described in terms of the AID medication(s) and the doses (and frequency) for each.

AID treatments are known in the art.

Type 1 diabetes treatments are known in the art and include any treatment purposed for improving the signs and symptoms of Type 1 diabetes, which can include increased thirst and urination, constant hunger, weight loss, blurred vision, and extreme fatigue, or, can include diabetic coma, also known as diabetic ketoacidosis. For example, medications for Type 1 diabetes include for instance, insulin (short-acting insulin, rapid-acting insulin, intermediate-acting insulin, long-acting insulin). In some aspects, the short-acting (regular) insulin is Humulin R and Novolin R. In various aspects, the rapid-acting insulin is glulisine (Apidra), insulin lispro (Humalog), or insulin aspart (Novolog). In various aspects, the long-acting insulin is glargine (Lantus, Toujeo Solostar), insulin detemir (Levemir) and insulin degludec (Tresiba), while the intermediate-acting insulin in some aspects is insulin NPH (Novolin N, Humulin N). Type 1 diabetes medications may be administered as an injection or through a pump. The treatment can in some aspects be an artificial pancreas, or like implanted device that links a continuous glucose monitor with an insulin pump. The type 1 diabetes treatment in some aspects comprises additional medications, including, for example, high blood pressure medications (e.g., an angiotensin converting enzyme (ACE) inhibitor or angiotensin II receptor blocker (ARB)), aspirin, and/or cholesterol-lowering medications. Additionally, immunosuppressants such as corticosteroids, fingolimod, dimethyl fumarate, and a variety of other medications may be used to prevent the onset of Type 1 Diabetes.

MS medications are known in the art and include corticosteroids (e.g., prednisone, prednisolone, methylprednisolone, dexamethasone, betamethasone, cortisone, fluorohydrocortisone,) or another standard of care that is purposed to limit neuroinflammation. In exemplary aspects, the MS treatment comprises one or more of: Alemtuzumab, fingolimod, IFN-beta, natalizumab, glatiramer acetate, ocrelizumab, dimethyl fumarate, teriflunomide, or mitoxantrone. The MS treatment may in some aspects comprises additional medications, including e.g., muscle relaxants, e.g., baclofen, tizanidine. Nanoparticles such as those described in the Examples may be used to induce tolerance to self-antigens may be used.

Other autoimmune treatments include, for instance, immune suppressing drugs, non-steroidal anti-inflammatory drugs, e.g., ibuprofen, naproxen. In some aspects, the AID treatment comprises one or more of: adalimumab, infliximab, methotrexate, toclizumab, rituximab, ofatumumab, belimumab, epratuzumab, abatacept, golimumab, certolizumab, sifalimumab, anakinra, canakinumab, rilonocept, intravenous immunoglobulin.

Samples

The samples of the methods of the present disclosure are samples obtained from a niche at the implantation site of a synthetic scaffold in the subject. At some point in time relative to when the sample is obtained, a synthetic scaffold was implanted in the subject. In exemplary aspects, the sample is obtained from a niche of a synthetic scaffold that has been removed or excised from the subject prior to the sample being taken. In exemplary aspects, the sample is obtained from a niche while the synthetic scaffold is still implanted in the subject. In exemplary instances, the sample is a core-needle biopsy obtained from the niche while the scaffold is still implanted in the subject. In exemplary aspects, the sample is a fine-needle aspiration obtained from the niche while the scaffold is still implanted into a subject. Such methods of obtaining samples are known in the art. See, e.g., Eom et al., *AJNR Am J Neuroradiol.* 2015 June; 36 (6): 1188-93.

In various aspects, the sample is representative of the niche which in some instances comprises cells and other molecules or factors involved in an immune response against the synthetic scaffold. In exemplary aspects, the sample comprises immune cells, stromal cells, or a combination thereof. In exemplary aspects, the sample comprises immune cells, including, but not limited to, macrophages, dendritic cells, MDSCs, neutrophils, monocytes, helper T cells, cytotoxic T cells, B cells, NK cells, CD45+ cells, and the like. In exemplary aspects, the sample comprises a combination of two or more of the above immune cell types. In exemplary aspects, the sample comprises stromal cells, including, for example, fibroblasts, endothelial cells, pericytes, and the like. In exemplary aspects, the sample comprises a combination of two or more of the above stromal cell types. In exemplary aspects, the sample comprises a combination of immune cells and stromal cells. In exemplary aspects, the sample comprises CD45+ cells. In exemplary aspects, the sample obtained from the niche comprises immune cells, stromal cells, extracellular matrix, secreted proteins, extracellular vesicles, or a combination thereof. In some aspects, the extracellular matrix comprises collagen, laminin, fibronectin, glycosaminoglycans, proteoglycans, matricellular proteins, and the like. In various instances, the secreted proteins is cytokines, chemokines, growth factors. In various aspects, the extracellular vesicles contain DNA, RNA, protein, microRNA.

Niches and Scaffolds

Implantation of synthetic scaffolds in a subject, e.g., in the subcutaneous space or fat pad, trigger in vivo events (e.g., a foreign body response, an immune response against the scaffold) that result in the creation of a niche in the subject at the implantation site. With regard to the methods of the present disclosure, the samples are obtained from the niche. As used herein, the term "niche" refers to the area of cells and molecules located at or near the site at which a synthetic scaffold is or was implanted in the subject (at the scaffold implantation site) which reflect the in vivo events caused by the implantation of the scaffold. In some aspects, the niche is physically attached to the scaffold. Without being bound to a particular theory, the niche comprises cells and other molecules or factors involved in an immune response against the synthetic scaffold implanted in the subject at the implantation site. Without being bound to a particular theory, the niche is representative of the subject's health status with regard to a disease, e.g., an autoimmune disease, or lack thereof, as the content of the niche changes as the disease changes (progresses, regresses). The niche in some aspects is biopsied, and the analysis of the biopsied sample allows for the disease diagnosis and/or prognosis, in addition to treatment monitoring.

The scaffold implanted into the subject may be any scaffold which mimics the cellular and molecular components of the niche and is able to capture or recruit or attract immune cells, stromal cells, and other molecules indicative of autoimmune disease (e.g., immune cells, stromal cells, extracellular matrix, secreted proteins, extracellular vesicles, or a combination thereof). In exemplary aspects, the scaffold maintains residence in tissue for several weeks to years and facilitates ingrowth of tissue and the retrieval of that tissue at later time points. Such scaffolds are known in the art. See, e.g., Azarin et al., Nat Commun 6:8094 (2015); Aguado et al., Sci Rep 5:17566 (2015); Aguado et al., Acta Biomaterialia (2016); and Rao et al., Cancer Res 76 (18): 5209-5218 (2016); U.S. Patent Application Publication No. 2014/0072510 A1; International Patent Application Publication No. WO 2017/120486.

In exemplary embodiments, the scaffold is porous and/or permeable. In exemplary embodiments, the scaffold comprises a polymeric matrix and acts as a substrate permissible for inflammation due to an autoimmune disease, etc. In exemplary embodiments, the scaffold provides an environment for attachment, incorporation, adhesion, encapsulation, etc. of agents (e.g., DNA, lentivirus, protein, cells, etc.) that create a capture site within the scaffold. In exemplary embodiments, agents are released (e.g., controlled or sustained release) to attract circulating cells or molecules indicative of inflammation and/or AID. With regard to agents (e.g., therapeutic agents) and sustained release, for long term therapy (e.g., days, weeks or months) and/or to maintain the highest possible drug concentration at a particular location in the body, the present disclosure in certain embodiments provides a sustained release depot formulation with the following non-limiting characteristics: (1) the process used to prepare the matrix does not chemically or physically damage the agent; (2) the matrix maintains the stability of the agent against denaturation or other metabolic conversion by protection within the matrix until release, which is important for very long sustained release; (3) the entrapped agent is released from the hydrogel composition at a substantially uniform rate, following a kinetic profile, and furthermore, a particular agent can be prepared with two or more kinetic profiles, for example, to provide in certain embodiments, a loading dose and then a sustained release dose; (4) the desired release profile can be selected by varying the components and the process by which the matrix is prepared; and (5) the matrix is nontoxic and degradable. PEG scaffolds as disclosed herein are also contemplated to function as a scaffold that achieves sustained release of a therapeutically active agent. Accordingly, in some embodiments an agent is configured for specific release rates. In further embodiments, multiple different agents are configured for different release rates. For example, a first agent may release over a period of hours while a second agent releases over a longer period of time (e.g., days, weeks, months, etc.). In some embodiments, and as described above, the scaffold or a portion thereof is configured for sustained release of agents. In some embodiments, the sustained release provides release of biologically active amounts of the agent over a period of at least 30 days (e.g., 40 days, 50 days, 60 days, 70 days, 80 days, 90 days, 100 days, 180 days, etc.).

In exemplary embodiments, the scaffold is partially or exclusively composed of a micro-porous poly(e-caprolactone) (PCL), forming a PCL scaffold. Such PCL scaffolds have a greater stability than the micro-porous poly(lactide-co-glycolide) (PLG) biomaterial scaffolds. In exemplary embodiments, the scaffold comprises PCL and/or PEG and/or alginate and/or PLG.

In some embodiments, the scaffold is a controlled release scaffold formed partially or exclusively of hydrogel, e.g., a poly(ethylene glycol) (PEG) hydrogel to form a PEG scaffold. Any PEG is contemplated for use in the compositions and methods of the disclosure. In general, the PEG has an average molecular weight of at least about 5,000 daltons. In further embodiments, the PEG has an average molecular weight of at least 10,000 daltons, 15,000 daltons, and is preferably between 5,000 and 20,000 daltons, or between 15,000 and 20,000 daltons. Also preferred is PEG having an average molecular weight of 5,000, of 6,000, of 7,000, of 8,000, of 9,000, of 10,000, of 11,000, of 12,000 of 13,000, of 14,000, or of 25,000 daltons. In further embodiments, the PEG is a four-arm PEG. In preferred embodiments, each arm of the four-arm PEG is terminated in an acrylate, a vinyl sulfone, or a maleimide. It is contemplated that use of vinyl sulfone or maleimide in the PEG scaffold renders the scaffold resistant to degradation. It is further contemplated that use of acrylate in the PEG scaffold renders the scaffold susceptible to degradation.

In some embodiments, one or more agents are associated with a scaffold to establish a hospitable environment for inflammation and/or to provide a therapeutic benefit to a subject. Agents may be associated with the scaffold by covalent or non-covalent interactions, adhesion, encapsulation, etc. In some embodiments, a scaffold comprises one or more agents adhered to, adsorbed on, encapsulated within, and/or contained throughout the scaffold. The present invention is not limited by the nature of the agents. Such agents include, but are not limited to, peptides, proteins, nucleic acid molecules, small molecule drugs, lipids, carbohydrates, cells, cell components, and the like. In various embodiments, the agent is a therapeutic agent. In some embodiments, two or more (e.g., 3, 4, 5, 6, 7, 8, 9, 10 . . . 20 . . . 30 . . . 40 . . . , 50, amounts therein, or more) different agents are included on or within the scaffold. In some embodiments, agents associated with a scaffold include inflammatory markers, such as: specific antigens relevant in disease (PLP or MOG or MBP for MS), cell lysates, chemokines and cytokines, CCL2, CCL1, CCL22, CCL5, CCL17, CXCL9, CXCL10 and CXCL11, IL-1b, IL-8, IL-2 and. In some embodiments, agents associated with a scaffold include lentivirus encoding a gene that aids in establishing a hospitable environment for inflammation and/or providing a therapeutic benefit to a subject. In other embodiments, no agents are provided with the scaffold. In some aspects, the scaffold is modified to deliver proteins, peptides, small molecules, gene therapies, biologics, etc. to enhance the signal to noise ratio. In particular if the scaffolds are designed to be more similar to the effected tissue in the autoimmune disease. (i.e. CNS for MS).

In further embodiments, it is contemplated that a scaffold of the disclosure recruits more and/or different cells relative to a scaffold that comprises, e.g., PLG. For example, in some embodiments a scaffold of the disclosure recruits more inflammatory cells than a scaffold that comprises, e.g., PLG. In various embodiments, a scaffold of the disclosure recruits and/or captures about 5, 10, 20, 50, 100, 200, 500, 1000 or more cells relative to a scaffold that comprises, e.g., PLG. In some embodiments, the types of cells that associate with a scaffold of the disclosure are different from a scaffold that comprises, e.g., PLG. For example and without limitation, a higher percentage of CD49b cells are found in association with a PCL scaffold relative to a PLG scaffold; further, there are about equal quantities of F4/80 and CDIIc cells in association with a PLG scaffold, whereas there are three times as many CDIIc cells as F4/80 cells in association with a PCL scaffold.

In certain embodiments, the scaffold comprises a polymeric matrix. In some embodiments, the matrix is prepared by a gas foaming/particulate leaching procedure, and includes a wet granulation step prior to gas foaming that allows for a homogeneous mixture of porogen and polymer and for sculpting the scaffold into the desired shape.

Thus, in some aspects, the scaffolds may be formed of a biodegradable polymer, e.g., PCL, that is fabricated by emulsifying and homogenizing a solution of polymer to create microspheres. Other methods of microsphere production are known in the art and are contemplated by the present disclosure. See, e.g., U.S. Patent Application Publication Numbers 2015/0190485 and 2015/0283218, each of which is incorporated herein in its entirety. The microspheres are then collected and mixed with a porogen (e.g., salt particles), and the mixture is then pressed under pressure. The resulting discs are heated, optionally followed by gas foaming. Finally, the salt particles are removed. The fabrication provides a mechanically stable scaffold which does not compress or collapse after in vivo implantation, thus providing proper conditions for cell growth.

In some aspects, the scaffolds are formed of a substantially non-degradable polymer, e.g., PEG. Degradable hydrogels encapsulating gelatin microspheres may be formed based on a previously described Michael-Type addition PEG hydrogel system with modifications [Shepard et al., Biotechnol Bioeng. 109 (3): 830-9 (2012)]. Briefly, four-arm polyethylene glycol) vinyl sulfone (PEG-VS) (20 kDa) is dissolved in 0.3 M triethanolamine (TEA) pH 8.0 at a concentration of 0.5 mg^L to yield a final PEG concentration of 10%. The plasmin-degradable trifunctional (3 cysteine groups) peptide crosslinker (Ac-GCYKN CGYKN CG) is dissolved in 0.3 M TEA pH 10.0 to maintain reduction of the free thiols at a concentration that maintain a stoichiometrically balanced molar ratio of VS:SH. Prior to gelation, gelatin microspheres are hydrated with 10 μl sterile Millipore or lentivirus solution. Subsequently, the PEG and peptide crosslinking solutions are mixed well and immediately added to the hydrated gelatin microspheres for encapsulation. In some embodiments, and as described above, salt is used as the porogen instead of gelatin microspheres. In this case, the PEG solution is made in a saturated salt solution, so that the porogen does not significantly dissolve.

In some embodiments, UV crosslinking is used instead of peptide crosslinking. Ultraviolet crosslinking is contemplated for use with PEG-maleimide, PEG-VS, and PEG-acrylate.

Scaffolds of the present disclosure may comprise any of a large variety of structures including, but not limited to, particles, beads, polymers, surfaces, implants, matrices, etc. Scaffolds may be of any suitable shape, for example, spherical, generally spherical (e.g., all dimensions within 25% of spherical), ellipsoidal, rod-shaped, globular, polyhedral, etc. The scaffold may also be of an irregular or branched shape.

In some embodiments, a scaffold comprises nanoparticles or microparticles (e.g., compressed or otherwise fashioned into a scaffold). In various embodiments, the largest cross-sectional diameters of a particle within a scaffold is less than about 1,000 μm, 500 μm, 200 μm, 100 μm, 50 μm, 20 μm, 10 μm, 5 μm, 2 μm, 1 μm, 500 nm, 400 nm, 300 nm, 200 nm or 100 nm. In some embodiments, a population of particles has an average diameter of: 200-1000 nm, 300-900 nm, 400-800 nm, 500-700 nm, etc. In some embodiments, the overall weights of the particles are less than about 10,000 kDa, less than about 5,000 kDa, or less than about 1,000 kDa, 500 kDa, 400 kDa, 300 kDa, 200 kDa, 100 kDa, 50 kDa, 20 kDa, 10 kDa.

In some embodiments, a scaffold comprises PCL. In further embodiments, a scaffold comprises PEG. In certain embodiments, PCL and/or PEG polymers and/or alginate polymers are terminated by a functional group of chemical moiety (e.g., ester-terminated, acid-terminated, etc.).

In some embodiments, the charge of a matrix material (e.g., positive, negative, neutral) is selected to impart application-specific benefits (e.g., physiological compatibility, beneficial interactions with chemical and/or biological agents, etc.). In certain embodiments scaffolds are capable of being conjugated, either directly or indirectly, to a chemical or biological agent). In some instances, a carrier has multiple binding sites (e.g., 2, 3, 4, 5, 6, 7, 8, 9, 10 . . . 20 . . . 50 . . . 100, 200, 500, 1000, 2000, 5000, 10,000, or more).

In exemplary embodiments, the life times of the scaffolds are well within the timeframe of clinical significance are demonstrated. For example, stability lifetimes of greater than 90 days are contemplated, with percent degradation profiles of less than about 50%, 45%, 40%, 35%, 30%, 25%, 20%, 15%, 10%, 5%, and 1% respectively, where the percent degradation refers to the scaffolds' ability to maintain its structure for sufficient cell capture as a comparison of its maximum capture ability. Such ability is measured, for example, as the change in porous scaffold volume over time, the change in scaffold mass over time, and/or the change in scaffold polymer molecular weight over time. These long life times mean that scaffolds can now be applied in patient-friendly conditions that allow subjects to wear the scaffold under normal daily living conditions, inside and outside the clinical environment.

Further still, the chronic utility of the niche provide the defined locations where disease-indicative or disease-driving cells may aggregate and thus facilitate their removal from the host.

The ability of the present scaffolds to remain functionalized over greater periods of time has, in some examples, provided for formation of a sustained or controllable release scaffold. These scaffolds, for example, may comprise protein responsive materials that are non-degradable when implanted and recruiting inflammatory cells and molecules. When exposed to activating proteins (e.g., an enzyme), however, these scaffolds degrade to then release the captured inflammatory cells and molecules. In some examples, such a property is contemplated for use in vitro to facilitate the recovery of the captured cells. For example and without limitation, in some examples the scaffold is an alginate scaffold and the activating protein is alginate lyase.

In some embodiments, the scaffold or a portion thereof is configured to be sufficiently porous to permit inflammatory cells and molecules into the pores. The size of the pores may be selected for particular cell types of interest and/or for the amount of ingrowth desired and are, for example without limitation, at least about 20 μm, 30 μm, 40 μm, 50 μm, 100 μm, 200 μm, 500 μm, 700 μm, or 1000 μm. In some embodiments, the PEG gel is not porous but is instead characterized by a mesh size that is, e.g., 10 nanometers (nm), 15 nm, 20 nm, 25 nm, 30 nm, 40 nm, or 50 nm.

Also the scaffold may be modified to deliver proteins, peptides, small molecules, gene therapies, biologics, etc. to enhance the signal to noise ratio. In exemplary aspects, if the scaffolds are designed to be more similar to the effected tissue in the autoimmune disease. (i.e. CNS for MS). This includes specific antigens known to be involved in disease (PLP, MOG, MBP for MS) or cell lysates from targeted organs (CNS for MS and B cells or pancreatic lysate for T1D). Furthermore, living cells from target tissues or extracts from these cells could be incorporated.

Scaffold Implantation Sites

An AID can be developed at many different parts of the body and thus, the scaffold could be implanted virtually anywhere in the body of the subject, certain considerations, e.g., ease of accessing, lend to a subcutaneous space or fat pad as possible sites for scaffold implantation. For instance, the scaffold implantation site is the subcutaneous space of the abdomen. Additionally or alternatively, in some embodiments, the scaffold is implanted subcutaneously. In exemplary aspects, more than one scaffold is implanted in the subject. In exemplary aspects, the subject comprises more than one scaffold. In further examples, at least 1, at least 2, at least 3, at least 4, at least 5, at least 6, at least 7, at least 8, at least 9, or at least 10 scaffolds are implanted in a subject. In exemplary aspects, samples from each of the scaffolds implanted in the subject are obtained and expression profiles of each sample are measured.

Measuring Expression Levels

The methods of the present disclosure relate to measuring a level of expression of a gene, an RNA, e.g., a messenger RNA (mRNA), or a protein, in a sample obtained from a niche at the implantation site of a synthetic scaffold. In exemplary embodiments, the methods comprise measuring a combination of at least two of an expression level of a gene, an RNA, and a protein. In exemplary embodiments, the methods comprise measuring the expression level of at least one gene, at least one RNA, and at least one protein. In exemplary instances, the methods comprise measuring the expression level of at least 2, 3, 4, 5 or more genes, at least 2, 3, 4, 5 or more RNA, and/or at least 2, 3, 4, 5 or more proteins in the sample. In exemplary instances, the methods comprise measuring the expression level of at least 10, 15, 20 or more genes, at least 10, 15, 20 or more RNA, and/or at least 10, 15, 20 or more proteins in the sample. In exemplary instances, the methods comprise measuring the expression level of at least 50, 100, 200 or more genes, at least 50, 100, 200 or more RNA, and/or at least 50, 100, 200 or more proteins in the sample. In exemplary instances, the methods comprise measuring the expression level of a plurality of different genes, a plurality of RNA, and/or a plurality of proteins.

In exemplary aspects, the methods comprise measuring the expression level of more than 10 different genes, more than 100 different genes, more than 1000 different genes, more than 5000-10,000 different genes, and the expression levels of the different genes constitute a gene signature.

In exemplary aspects, the methods comprise measuring the expression level of more than 10 different RNA, more than 100 different RNA, more than 1000 different RNA, more than 5000-10,000 different RNA, and the expression levels of the different RNA constitute an RNA signature, or a transcriptome.

In exemplary aspects, the methods comprise measuring the expression level of more than 10 different proteins, more than 100 different proteins, more than 1000 different proteins, more than 5000-10,000 different proteins, and the expression levels of the different proteins constitute a protein signature, or a proteome.

In exemplary aspects, the methods comprise measuring the expression level of at least one or more of the following genes: IL1B, TNFRSF11b, CXCL5, CD163, or VEGFA, or an expression product (e.g., an RNA or protein) encoded thereby. In exemplary aspects, the methods comprise measuring the expression level of at least two or more of the following genes: IL1B, TNFRSF11b, CXCL5, CD163, or VEGFA, or an expression product (e.g., an RNA or protein) encoded thereby. In exemplary aspects, the methods comprise measuring the expression level of at least 3 or 4 or all 5 of the following genes: IL1B, TNFRSF11b, CXCL5, CD163, or VEGFA, or an expression product (e.g., an RNA or protein) encoded thereby. In exemplary aspects, the methods comprise measuring the expression level of each of the following genes: IL1B, TNFRSF11b, CXCL5, CD163, or VEGFA, or an expression product (e.g., an RNA or protein) encoded thereby.

In various aspects, the method comprises measuring a level of expression of one or more of the genes of Group I, Group II, or Group III, or a combination thereof genes, optionally, comprising measuring a level of expression of the RNA or protein encoded by one of the above genes:

In exemplary aspects, one or more of the genes of Group III are measured. In exemplary aspects, at least 2, 3, 4, 5 or 6 genes of Group III are measured. In exemplary aspects, at least 7, 8, 9, or 10 genes of Group III are measured. In exemplary aspects, at least 11, 12, 13, 14, or 15 genes of Group III are measured. In exemplary aspects, more than 15 (e.g., 16, 17, 18, 19, 20) genes of Group III are measured. In exemplary aspects, all 21 genes of Group III are measured.

In exemplary aspects, at least one gene from Group I and one gene from Group II or Group III are measured. In exemplary aspects, at least one gene from Group II and one gene from Group I or Group III are measured. In exemplary aspects, at least one gene from Group III and one gene from Group I or Group II are measured. In exemplary aspects, at least one gene from each of Group I, Group II, and Group III are measured. In exemplary aspects, at least 2, 3, 4, or 5 genes from Group I and at least 2, 3, 4, or 5 genes from Group II or Group III are measured. In exemplary aspects, at least 2, 3, 4, or 5 genes from Group II and at least 2, 3, 4, or 5 genes from Group I or Group III are measured. In exemplary aspects, at least 2, 3, 4, or 5 genes from Group III and at least 2, 3, 4, or 5 genes from Group I or Group II are measured. In exemplary aspects, at least 2, 3, 4, or 5 genes from each of Group I, Group II, and Group III are measured. In exemplary aspects, at least 6, 7, 8, 9, or 10 genes from Group I and at least 6, 7, 8, 9, or 10 genes from Group II or Group III are measured. In exemplary aspects, at least 6, 7, 8, 9, or 10 genes from Group II and at least 6, 7, 8, 9, or 10 genes from Group I or Group III are measured. In exemplary aspects, at least 6, 7, 8, 9, or 10 genes from Group III and at least 6, 7, 8, 9, or 10 genes from Group I or Group II are measured. In exemplary aspects, at least 6, 7, 8, 9, or 10 genes from each of Group I, Group II, and Group III are measured. In exemplary aspects, at least 11, 12, 13, 14, or 15 genes from Group I and at least 11, 12, 13, 14, or 15 genes from Group II or Group III are measured. In exemplary aspects, at least 11, 12, 13, 14, or 15 genes from Group II and at least 11, 12, 13, 14, or 15 genes from Group I or Group III are measured. In exemplary aspects, at least 11, 12, 13, 14, or 15 genes from Group III and at least 11, 12, 13, 14, or 15 genes from Group I or Group II are measured. In exemplary aspects, at least 11, 12, 13, 14, or 15 genes from each of Group I, Group II, and Group III are measured. In exemplary aspects, more than 15 genes from Group I and 15 or more genes from Group II or Group III are measured. In exemplary aspects, 15 genes from Group II and 15 or more genes from Group I or Group III are measured. In exemplary aspects, 15 or more genes from Group III and 15 or more genes from Group I or Group II are measured. In exemplary aspects, 15 or more genes from each of Group I, Group II, and Group III are measured. In exemplary aspects, each gene from each of Group I, Group II, and Group III are measured.

| | |
|---|---|
| Group I | ADRB2, BDKRB1, CD163, CFB, CLEC7A, CXCL1, CXCL5, EREG, FN1, IL1B, IL1F9, IL6, LIF, OLR1, PTGS2, TNFRSF11B, TREM1, VEGFA, CXCL3, CXCL2, S100A9 |
| Group II | PRTN3, ELA2, LTF, CAMP, CHI3L3, S100A8, S100A9, IL8RB, CSF3, H2Q10, CD55, LEFTY, CCL22, IL12B, FOXP3 |
| Group III | CD163, PTGS2, TNFRSF11B, VEGFA, FN1, IL6, BDKRB1, S100A9, CXCL1, CXCL3, CFB, CLEC7A, IL1B, IL1F9, CXCL5, OLR1, LIF, CXCL2, TREM1, EREG, ADRB2 |

In exemplary aspects, one or more of the genes of Group I are measured. In exemplary aspects, at least 2, 3, 4, 5 or 6 genes of Group I are measured. In exemplary aspects, at least 7, 8, 9, or 10 genes of Group I are measured. In exemplary aspects, at least 11, 12, 13, 14, or 15 genes of Group I are measured. In exemplary aspects, more than 15 (e.g., 16, 17, 18, 19, 20) genes of Group I are measured. In exemplary aspects, all 21 genes of Group 1 are measured.

In exemplary aspects, one or more of the genes of Group II are measured. In exemplary aspects, at least 2, 3, 4, 5 or 6 genes of Group II are measured. In exemplary aspects, at least 7, 8, 9, or 10 genes of Group II are measured. In exemplary aspects, at least 11, 12, 13, 14, or all 15 genes of Group II are measured.

In exemplary aspects, the AID is multiple sclerosis (MS), optionally, relapsing-remitting MS (RR-MS). In such aspects, the AID treatment is fingolimod, corticosteroids, IFN-beta, natalizumab, glatiramer acetate, ocrelizumab, dimethyl fumarate, teriflunomide, Alemtuzumab, or mitoxantrone. In some instances, the gene is one of Group I genes. In alternative instances, the AID is diabetes, optionally, Type 1 diabetes, and the gene is one of Group III genes.

In additional or alternative exemplary aspects, the methods comprise measuring a level of expression of one or more of the following genes or the RNA or protein encoded by one or more of the following genes: Actb, B2m, Cdkn1a, Gusb, Hprt1, Ipo8, Pgk1, Polr2a, Ppia, Rplp2, Tfrc, 5730403B10Rik, A2m, Abcb1a, Abcf1, Acvr1, Acvr2b, Acvrl1, Adipoq, Adora1, Adora2a, Adora3, Adrb2, Afap1l2, Aif1, Aimp1, Aimp1, Akt1, Alox15, Alox5, Alox5, Alox5, Alox5, Alox5, Alox5, Alox5ap, Anxa1, Aoah, Aoc3, Aox1, Apcs, Apoa1, Apoa1, Apoa4, Apoe, Areg, Atrn, Axl, B4galt1, Bad, Bcl10, Bcl6, Bdkrb1, Bdkrb2, Blnk, Bmp1, Bmp10, Bmp2, Bmp3, Bmp3, Bmp4, Bmp5, Bmp6, Bmp6, Bmp7, Bmp7, Bmp7, Bmp8a, Bmp8b, Bmpr1b, Bre, C1qa, C1qb, C1qc, C1rl, C1s, C2, C3, C3ar1, C3ar1, C6, C8a, C8b, C8g, C9, Casp1, Casp8, Cav1, Ccbp2, Ccl1, Ccl11, Ccl17, Ccl19, Ccl2, Ccl20, Ccl24, Ccl25, Ccl26, Ccl28, Ccl3, Ccl4, Ccl5, Ccl5, Ccl6, Ccl7, Ccl7, Ccl8, Ccr1, Ccr1l1, Ccr2, Ccr3, Ccr3, Ccr4, Ccr5, Ccr6, Ccr8, Ccr8, Ccr9, Ccrl1, Ccrl2, Cd14, Cd163, Cd180, Cd1d1, Cd24a, Cd274, Cd28, Cd4, Cd40, Cd40lg, Cd44, Cd46, Cd55, Cd70, Cd74, Cd80, Cd86, Cd97, Cdk5, Cdo1, Cebpa, Cebpb, Cer1, Cfb, Cfd, Cfh, Cfhr1, Cfi, Cfp, Cftr, Chrna7, Chst1, Chst2, Chst4, Cklf, Clcf1, Clec7a, Clu, Cmklr1, Cmtm2a, Cmtm2b, Cmtm3, Cmtm4, Cmtm5, Cmtm6, Cmtm7, Cmtm8, Cntfr, Cntfr, Cntnap1, Cr1l, Cr2, Crh, Crlf1, Crp, Csf1, Csf2, Csf2, Csf2ra, Csf2rb, Csf3, Ctf1, Ctla4, Cx3cl1, Cx3cr1, Cxcl1, Cxcl1, Cxcl10, Cxcl11, Cxcl12, Cxcl14, Cxcl16, Cxcl17, Cxcl3, Cxcl5, Cxcl9, Cxcr3, Cxcr3, Cxcr4, Cxcr6, Cxcr7, Cybb, Cyp26b1, Darc, Ddx58, Dnajc8, Ebi3, Eda2r, Egfr, Egfr, Ephx2, Epo, Erap1, Erbb2, Ereg, F11r, F2, F2r, F2rl1, F3, Fabp4, Fabp4, Fam3b, Fam3c, Fas, Fasl, Fcer1a, Fcer1g, Fcgr2b, Fgf10, Fgf11, Fgf12, Fgf18, Fgf2, Fgf20, Fgf23, Figf, Flt31, Fn1, Fos, Fos, Foxp3, Fpr1, Fpr3, Gal, Gdf11, Gdf15, Gdf2, Gdf3, Gdf5, Gdf6, Gdf9, Gh, Ghrl, Ghsr, Glmn, Gpr17, Gpr68, Gpx1, Gpx4, Grem1, Grem2, Grn, Gsk3b, Gusb, Gusb, H2Q10, H47, Havcr2, Hc, Hdac4, Hdac4, Hdac4, Hdac5, Hdac5, Hdac5, Hdac7, Hdac7, Hdac9, Hgf, Hgf, Hgf, Hif1a, Hmgb1, Hmox1, Hprt1, Hprt1, Hprt1, Hpse, Hrh1, Hrh1, Hsp90ab1, Hspd1, Icos, Icosl, Ifih1, Ifna12, Ifna14, Ifna2, Ifna4, Ifnar1, Ifnar2, Ifnb1, Ifne, Ifng, Ifng, Ifngr1, Ifngr2, Ifnk, Igf1, Igfbp4, Ik, Il10, Il10ra, Il10rb, Il12a, Il12a, Il12b, Il12b, Il12rb1, Il12rb2, Il13, Il13, Il13ra1, Il13ra1, Il13ra2, Il15, Il15ra, Il16, Il17a, Il17c, Il17d, Il17f, Il17ra, Il17rb, Il18, Il18 bp, Il18rap, Il19, Il1a, Il1b, Il1b, Il1f10, Il1f5, Il1f6, Il1f9, Il1r1, Il1rap, Il1rapl2, Il1rl1, Il1rl2, Il1rn, Il2, Il2, Il20, Il21, Il22; Iltifb, Il22ra1, Il22ra2, Il23a, Il23r, Il24, Il27, Il27ra, Il28b, Il28ra, Il28ra, Il2rg, Il3, Il31ra, Il33, Il3ra, Il4, Il4ra, Il5, Il5ra, Il6, Il6, Il6, Il6ra, Il6st, Il7r, Il8ra, Il8rb, Il9, Inha, Inhba, Inhbb, Ins2, Irak1, Irak2, Irak3, Irak4, Irf3, Irf3, Irf7, Itgal, Itgam, Itgb2, Itgb21, Itgb6, Jak1, Jak2, Jak3, Jun, Kit, Kitl, Klf6, Klkb1, Klrg1, Kng1, Krt1, Krt7, Krt8, Lbp, Leftyl; Lefty2, Lefty2, Lefty2, Lefty2, Lep, Lepr, Lif, Lifr, Lifr, Lilrb3, Lrp8, Lta4h, Ltb, Ltb4r1, Ltbp4, Ltbp4, Ltbr, Ly75, Ly86, Lyn, Malt1, Map2k3, Map2k6, Mapk14, Mapk8, Mapkapk2, Masp1, Masp2, Mbl2, Mefv, Mgll, Mmp25, Mrc1, Mstn, Muc1, Muc4, Myd88, Ncam1, Ncf1, Ndst1, Nfam1, Nfatc3, Nfatc4, Nfe211, Nfkb1, Nfrkb, Nfx1, Nlrc4, Nlrp3, Nmi, Nod1, Nod2, Nodal, Nono, Nos2, Nox4, Nr3c1, Nup85, Oit1, Olr1, Orm1, Osm, Oxgr1, P2rx1, P2rx7, P2ryl, Pdgfb, Pik3r1, Pla2g2d, Pla2g2e, Pla2g4c, Pla2g7, Plaa, Plp2, Pparg, Pparg, Ppbp, Ppia, Ppia; E030024N20Rik, Prdx5, Prg2, Prl7d1, Procr, Prok2, Prok2, Prtn3, Ptafr, Pten, Ptges, Ptgs1, Ptgs2, Ptn, Ptpn6, Ptprc, Ptx3, Ptx3, Pxdn, Pxmp2, Pycard, Rac1, Rbm4, Rcan1, Reg3a, Reg3g, Rela, Retn, Rhoa, Rhoa, Rhoa, Ripk2, Ryr1, S100a8, S100b, S1pr1, S1pr3, Saa1, Saa3, Scgb3a1, Scn9a, Scube1, Sdcbp, Sectm1b, Sele, Selp, Serpina1a, Serpina3c, Serpinf2, Serping1, Sftpa1, Sh2b2, Siglec1, Siva1, Slcola4, Slurp1, Socs1, Socs2, Sod1, Sod1, Spp1, Spred1, Spred2, Stab1, Stat1, Stat3, Stat4, Stat5b, Stat6, Tacr1, Tgfb1, Tgfb2, Tgfbr1, Tgfbr1, Tgm2, Thpo, Timm50, Tirap, Tlr1, Tlr1, Tlr1; Tlr6, Tlr11, Tlr12, Tlr13, Tlr2, Tlr3, Tlr4, Tlr5, Tlr6, Tlr7, Tlr9, Tnc, Tnf, Tnfaip3, Tnfaip6, Tnfrsf11b, Tnfrsf14, Tnfrsf18, Tnfrsf19, Tnfrsf1a, Tnfrsf1a, Tnfrsf1b, Tnfrsf25, Tnfrsf4, Tnfrsf8, Tnfrsf9, Tnfsf10, Tnfsf11, Tnfsf12; Tnfsf12-tnfsf13, Tnfsf13; Tnfsf12-tnfsf13, Tnfsf13b, Tnfsf14, Tnfsf15, Tnfsf18, Tnfsf4, Tnfsf8, Tnfsf9, Tollip, Tpst1, Trem1, Trf, Trip6, Trp53, Trpv1, Tslp, Twist1, Txlna, Unc13d, Vegfa, Vegfb, Vegfc, Vip, Vps45, Wnt16, Xcl1, Xcr1, Zfp36.

In exemplary aspects, the methods comprise measuring a level of expression of one or more of the following genes or the RNA or protein encoded by one or more of the following genes: Ltbp4, Hc, IL1f9, FGF23, Lep, Aox1, Kit1, Fcer1a, CD55, Bmp6, Spp1, Ccl2, or Ccl7. A summary of these genes follows (descriptions of IL1F9 and CD55 are elsewhere):

| Short Name | Longer name | Exemplary Protein Accession Nos. |
|---|---|---|
| Ltbp4 | Latent Transforming Growth Factor Beta Binding Protein 4 | NP_001036009.1, NP_001036010.1, and NP_003564.2 |
| FGF23 | Fibroblast Growth Factor 23 | NP_065689.1 |
| Lep | Leptin | NP_000221.1 |
| Aoxl | Aldehyde Oxidase 1 | NP_001150.3 |
| Kitl | KIT Proto-Oncogene, Receptor Tyrosine Kinase | NP_000213.1, NP_001087241.1 |
| Fcerla | Fc Fragment Of IgE Receptor Ia | NP_001992.1 |
| Bmp6 | Bone Morphogenetic Protein 6 | NP_001709.1 |
| Spp1 | Secreted Phosphoprotein 1 | NP_000573.1, NP_001035147.1, NP_001035149.1 |
| Ccl2 | C-C Motif Chemokine Ligand 2 | NP_002973.1 |
| Ccl7 | C-C Motif Chemokine Ligand 7 | NP_006264.2 |

The above genes, as well as the RNA and proteins encoded by the genes, are known in the art. The sequences of each are available at the website for the National Center for Biotechnology Information (see Table A), some sequences of which are provided in the sequence listing submitted herewith.

TABLE A

| Gene Name (abbreviation)*** | Gene ID* | NCBI Reference Sequence Accession Nos. (SEQ ID NOs:)** |
|---|---|---|
| adrenoceptor beta 2 (ADRB2) | 154 | NM_000024.5 (91)→ NP_000015.1 (92) |
| bradykinin receptor B1 (BDKRB1) | 623 | NM_000710.3 (93) → NP_000701.2 (94) |
| cathelicidin antimicrobial peptide (CAMP) | 820 | seq 52 AND 52 |
| C-C motif chemokine ligand 22 (CCL33) | 6367 | SEQ 1 AND 2 |
| CD163 | 9332 | NM_004244.5 (95)→ NP_004235.4 (96)<br>NM_203416.3 (97) → NP_981961.2 (98) |
| CD55 | 1604 | NM_000574.4 (99) → NP_000565.1 (100)<br>NM_001114752.2 (101) → NP_001108224.1 (102) |
| complement factor B (CFB) | 629 | NM_001710.5 (103) → NP_001701.2 (104) |
| chitinase-like 3 (CHIL3) | 12622 | SEQ 29 AND 30 |
| C-type lectin domain containing 7A (CLEC7A) | 64581 | NM_022570.4 (105) → NP_072092.2 (106)<br>NM_197947.2 (107)→ NP_922938.1 (108) |
| colony stimulating factor 3 (CSF3) | 1440 | Seq 15-22 |
| C-X-C motif chemokine ligand 1 (CXCL1) | 2919 | NM_001511.3 (109)→ NP_001502.1 (110) |
| C-X-C motif chemokine ligand 2 (CXCL2) | 2920 | seq 3-4 |
| C-X-C motif chemokine ligand 3 (CXCL3) | 2921 | NM_002090.2 (111) → NP_002081.2 (112) |
| C-X-C motif chemokine ligand 5 (CXCL5) | 6374 | NM_002994.4 (113)→ NP_002985.1 (114) |
| elastase, neutrophil expressed (ELANE) | 1991 | SEQ 49-50 |
| epiregulin (EREG) | 2069 | NM_001432.2 (115)→ NP_001423.1 (116) |
| fibronectin 1 (FN1) | 2335 | NM_001306129.1 (117)→ NP_001293058.1 (118)<br>NM_001306130.1 (119) → NP_001293059.1 (120) |
| forkhead box P3 (FOXP3) | 50943 | NM_001114377.1 (121)→ NP_001107849.1 (122)<br>NM_014009.3 (123)→ NP_054728.2 (124) |
| histocompatibility 2, Q region locus 10 (H2-Q10) | 15007 | NM_010391.4 (125)→ NP_034521.1 (126) |
| interleukin 12B (IL12B) | 3593 | NM_002187.2 (127)→ NP_002178.2 (128) |
| interleukin 1 beta (IL1B) | 3553 | NM_000576.2 (129)→ NP_000567.1 (130) |
| interleukin 1 family, member 9 (IL1F9) | 215257 | NM_153511.3 (131)→ NP_705731.2 (132) |
| interleukin 6 (IL6) | 3569 | NM_000600.4 (133)→ NP_000591.1 (134)<br>NM_001318095.1 (135)→ NP_001305024.1 (136) |
| C-X-C motif chemokine receptor 2 (CXCR2) | 3579 | NM_001168298.1 (137) → NP_001161770.1 (138)<br>NM_001557.3 (139)→ NP_001548.1 (140) |
| left-right determination factor 1 (LEFTY) | 10637 | NM_020997.3 (141)→ NP_066277.1 (142) |
| interleukin 6 family cytokine (LIF) | 3976 | NM_001257135.1 (143) → NP_001244064.1 (144)<br>NM_002309.4 (145)→ NP_002300.1 (146) |
| lactotransferrin (LTF) | 4057 | Seq 41-48 |
| oxidized low density lipoprotein receptor 1 (OLR1) | 4973 | NM_001172632.1 (147)→ NP_001166103.1 (148)<br>NM_001172633.1 (149) → NP_001166104.1 (150) |
| proteinase 3 (PRTN3) | 5657 | NM_002777.3 (151)→ NP_002768.3 (152) |
| prostaglandin-endoperoxide synthase 2 (PTGS2) | 5743 | NM_000963.3 (153) → NP_000954.1 (154) |
| S100 calcium binding protein A8 (S100A8) | | NM_001319196.1 (31)<br>NM_001319197.1 (33)<br>NM_001319198.1 (35)<br>NM_001319201.1 (37)<br>NM_002964.4 (39)<br>NP_001306125.1 isoform a (32)<br>NP_001306126.1 isoform b (34)<br>NP_001306127.1 isoform c (36)<br>NP_001306130.1 isoform d (38)<br>NP_002955.2 isoform d with alt splice junction (40) |
| S100 calcium binding protein A9 (S100A9) | 6280 | NM_002965.3 (27) → NP_002956.1 (28) |
| TNF receptor superfamily member 11b (TNFRSF11B) | 4982 | NM_002546.3 (155)→ NP_002537.3 (156) |
| triggering receptor expressed on myeloid cells 1 (TREM1) | 54210 | NM_001242589.2 (157) → NP_001229518.1 (158)<br>NM_001242590.2 (159)→ NP_001229519.1 (160) |
| vascular endothelial growth factor A (VEGFA) | 7422 | NM_001025366.2 (161)→ NP_001020537.2 (162)<br>NM_001025367.2 (163)→ NP_001020538.2 (164) |
| C-X-C motif chemokine | 2833 | NM_001142797.1 (165)→ NP_001136269.1 (166) |

TABLE A-continued

| Gene Name (abbreviation)*** | Gene ID* | NCBI Reference Sequence Accession Nos. (SEQ ID NOs:)** |
|---|---|---|
| receptor 3 (CXCR3) | | NM_001504.1 (167) → NP_001495.1 (168) |
| killer cell lectin like | 10219 | NM_001329099.1 (169)→ NP_001316028.1 (170) |
| receptor G1 (KLRG1) | | NM_001329101.1 (171)→ NP_001316030.1 (172) |
| C-C motif chemokine | 6369 | XM_011516459.2 (173)→ XP_011514761.1 (174) |
| ligand 24 (CCL24) | | XM_011516460.2 (175) → XP_011514762.1 (176) |
| protein C receptor (ROCR) | 10544 | NM_006404.4 (177)→ NP_006395.2 (178) |
| mannan binding lectin serine | 5648 | NM_001031849.2 (179)→ NP_001027019.1 (180) |
| peptidase 1 (MASP) | | NM_001879.5 (181)→ NP_001870.3 (182) |

*ID number of the Gene database of the NCBI at https://www.ncbi.nlm.nih.gov/gene/;

**Accession numbers beginning with "NM" are for nucleotide sequences of mRNA and "NP" for protein sequences.

***Information for human genes are provided or mouse genes if human not available.

Suitable methods of determining expression levels of nucleic acids (e.g., mRNA) are known in the art and include quantitative polymerase chain reaction (qPCR), including, but not limited to, quantitative real-time PCR (qRT-PCR), RNAseq, Northern blotting and Southern blotting. Techniques for measuring gene expression include, for example, gene expression assays with or without the use of gene chips are described in Onken et al., J Molec Diag 12 (4): 461-468 (2010); and Kirby et al., Adv Clin Chem 44:247-292 (2007). Affymetrix gene chips and RNA chips and gene expression assay kits (e.g., Applied Biosystems™ TaqMan® Gene Expression Assays) are also commercially available from companies, such as ThermoFisher Scientific (Waltham, MA). Suitable methods of determining expression levels of proteins are known in the art and include immunoassays (e.g., Western blotting, an enzyme-linked immunosorbent assay (ELISA), a radioimmunoassay (RIA), and immunohistochemical assay) or bead-based multiplex assays, e.g., those described in Djoba Siawaya J F, Roberts T, Babb C, Black G, Golakai H J, Stanley K, et al. (2008) An Evaluation of Commercial Fluorescent Bead-Based Luminex Cytokine Assays. PLOS ONE 3 (7): e2535. Proteomic analysis which is the systematic identification and quantification of proteins of a particular biological system are known. Mass spectrometry is typically the technique used for this purposes. Protein expression Suitable methods of measuring expression are described herein. See the section entitled EXAMPLES.

Controls

In the methods described herein, the level that is measured may be the same as a control level or a cut off level or a threshold level, or may be increased or decreased relative to a control level or a cut off level or a threshold level. In some aspects, the control level is that of a control subject which may be a matched control of the same species, gender, ethnicity, age group, smoking status, BMI, current therapeutic regimen status, medical history, or a combination thereof, but differs from the subject being diagnosed in that the control does not suffer from the disease in question or is not at risk for the disease. Thus, in exemplary aspects, the control level(s) of the gene(s), RNA, or protein(s) is/are level(s) of a subject known to not have an autoimmune disease. In alternative aspects, the control level(s) of the gene(s), RNA, or protein(s) is/are level(s) of a subject known to have an autoimmune disease. In exemplary aspects, as further described herein, the measured level is compared to both a control level of a subject known to not have an autoimmune disease and a control level of a subject known to have an autoimmune disease. In exemplary aspects, as further described herein, the measured level is compared to multiple control levels: a control level of a subject known to not have an autoimmune disease and several control levels of subjects known to have an autoimmune disease but differ from one another by the stage of an autoimmune disease. For example, a panel of control levels may be used to compare the measured level and the panel of control levels include a control level of a subject who does not have an autoimmune disease, a control level of a subject known to have a pre-symptomatic stage of an autoimmune disease, a control level of a subject known to have a symptomatic stage of an autoimmune disease, a control level of a subject known to be in an early stage of an autoimmune disease, and a control level of a subject known to be in a intermediate-stage of an autoimmune disease. In exemplary aspects, the panel of control levels are graphically displayed as elliptical areas, wherein each elliptical area represents the average and standard deviation of the control level in regards to two metrics that measure the likelihood of AID (with one metric on the x-axis and another on the y). In some instances, the measured level is plotted on this graphic and the distance from the nearest control elliptical area is indicative of the subject's AID.

In exemplary aspects, the method comprises measuring the level of expression of a gene, RNA, or protein at a first time point and at a second time point and the measured level of the first time point serves as a control level or establishes a baseline.

Relative to a control level, the level that is determined may an increased level. As used herein, the term "increased" with respect to level (e.g., expression level, biological activity level) refers to any % increase above a control level. The increased level may be at least or about a 5% increase, at least or about a 10% increase, at least or about a 15% increase, at least or about a 20% increase, at least or about a 25% increase, at least or about a 30% increase, at least or about a 35% increase, at least or about a 40% increase, at least or about a 45% increase, at least or about a 50% increase, at least or about a 55% increase, at least or about a 60% increase, at least or about a 65% increase, at least or about a 70% increase, at least or about a 75% increase, at least or about a 80% increase, at least or about a 85% increase, at least or about a 90% increase, at least or about a 95% increase, relative to a control level.

Relative to a control level, the level that is determined may a decreased level. As used herein, the term "decreased" with respect to level (e.g., expression level, biological activity level) refers to any % decrease below a control level. The decreased level may be at least or about a 5% decrease, at least or about a 10% decrease, at least or about a 15% decrease, at least or about a 20% decrease, at least or about a 25% decrease, at least or about a 30% decrease, at least or about a 35% decrease, at least or about a 40% decrease, at least or about a 45% decrease, at least or about a 50% decrease, at least or about a 55% decrease, at least or about a 60% decrease, at least or about a 65% decrease, at least or about a 70% decrease, at least or about a 75% decrease, at least or about a 80% decrease, at least or about a 85% decrease, at least or about a 90% decrease, at least or about a 95% decrease, relative to a control level.

Housekeeping Genes

For purposes herein, the levels of expression are measured and the measured levels may be normalized or calibrated to a level of a housekeeping gene. The housekeeping gene in some aspects is GAPDH, Hmbs, Tbp, Ubc, Ywhaz, Polr2a. In exemplary aspects, the housekeeping gene is any one of those set forth in the Table B or any one of those comprising a sequence of SEQ ID NOs: 55-90 and 183-184.

TABLE B

| Gene Name | NCBI Accession No. |
|---|---|
| Actin, beta (ACTB) | NM_001101 |
| aldolase A, fructose-bisphosphate (ALDOA) | NM_000034 |
| Glyceraldehyde-3-phosphate dehydrogenase (GAPDH) | NM_002046 |
| Phosphoglycerate kinase 1 (PGK1) | NM_000291 |
| RNA polymerase II subunit A (POLR2A) | NM_000937.4 |
| | NP_000928.1 |
| Lactate dehydrogenase A (LDHA), | NM_005566 |
| Ribosomal protein S27a (RPS27A) | NM_002954 |
| Ribosomal protein L19 (RPL19) | NM_000981 |
| Ribosomal protein L11 (RPL11) | NM_000975 |
| Non-POU domain containing, octamer-binding (NONO) | NM_007363 |
| Rho GDP dissociation inhibitor (GDI) alpha (ARHGDIA) | NM_004309 |
| Ribosomal protein L32 (RPL32) | NM_000994 |
| Ubiquitin C (UBC) | NM_021009 |
| HMBS | NM_000190.3 |
| | NM_001024382.1 |
| | NM_001258208.1 |
| | NM_001258209.1 |
| TBP | NM_001172085.1 |
| | NM_003194.4 |
| Ywhaz | NM_001135699.1 |
| | NM_001135700.1 |
| | NM_001135701.1 |
| | NM_001135702.1 |
| | NM_003406.3 |
| | NM_145690.2 |

Subjects

In exemplary aspects, the subject is a mammal, including, but not limited to, mammals of the order Rodentia, such as mice and hamsters, and mammals of the order Logomorpha, such as rabbits, mammals from the order Carnivora, including Felines (cats) and Canines (dogs), mammals from the order Artiodactyla, including Bovines (cows) and Swines (pigs) or of the order Perssodactyla, including Equines (horses). In some aspects, the mammals are of the order Primates, Ceboids, or Simoids (monkeys) or of the order Anthropoids (humans and apes). In some aspects, the mammal is a human. In some aspects, the human is an adult aged 18 years or older. In some aspects, the human is a child aged 17 years or less. In exemplary aspects, the subject has an autoimmune disease. The autoimmune disease may be any of those known in the art or described herein. In exemplary aspects, the subject has been diagnosed with the autoimmune disease and optionally the subject is taking an AID treatment. In exemplary aspects, the subject has been diagnosed with the autoimmune disease and the subject is not taking treatment. The presently disclosed method of determining treatment is particularly useful for the subject who has been diagnosed with the AID but not yet taking any treatment for the AID. In exemplary aspects, the subject has not yet been diagnosed with an AID. The presently disclosed method of detecting or diagnosing an AID or a predisposition thereto is especially useful for a subject who has not yet been diagnosed with an AID. The presently disclosed method in some aspects, characterizes the AID in terms of its stage, e.g., pre-symptomatic, symptomatic, in relapse, in remission, immediately preceding relapse or remission, and the like. Additionally or alternatively, the presently disclosed methods determine the need for AID treatment, upon diagnosis or determination of the AID. In some aspects, the subject has been diagnosed and the subject is taking an AID treatment. The presently disclosed methods in some aspects determines the effectiveness of the AID treatment. In some aspects, the methods disclosed herein determine that the AID is regressing upon treatment, while in other aspects, the methods determine that the AID is not regressing upon treatment or even progressing despite treatment.

Additional Steps

With regard to the methods of the invention, the methods may include additional steps. For example, the method may include repeating one or more of the recited step(s) of the method. Accordingly, in exemplary aspects, the method comprises measuring a level of expression of a gene, an RNA, or a protein, in a sample obtained from a niche or a scaffold and re-measuring the level, e.g., at a different time point, for accuracy. In exemplary aspects, the method comprises implanting the scaffold into the subject, e.g., implanting in the subject an implant (e.g., a scaffold) and allowing the niche to form in the subject prior to measuring the level of expression of the gene, RNA, or protein, or combination thereof. In exemplary aspects, the method comprises obtaining the sample from the subject. In exemplary embodiments, more than one sample is obtained from the scaffold. In exemplary embodiments, 2, 3, 4, 5, 6, 7, 8, 9, 10, or more samples are obtained from the scaffold, each sample obtained at a different point in time. In exemplary aspects, a sample is obtained from the scaffold once a day, 2× per day, 3× per day, 4× per day or more frequently. In exemplary aspects, a sample is obtained from the scaffold every 2, 3, 4, 5, or 6 days. In exemplary aspects, a sample is obtained from the scaffold once a week or once every 2 weeks, 3 weeks, 4 weeks, 5 weeks, 6 weeks, 7 weeks, or 8 weeks or less frequently. In exemplary aspects, a sample is obtained on a regular basis based on the analysis of a first sample. In exemplary aspects, a sample is obtained on a regular basis until a pre-determined goal is met. In exemplary aspects, the pre-determined goal is the determination of the subject as exhibiting a complete therapeutic response to a treatment.

In exemplary aspects, the method comprises measuring an expression level for every sample obtained. In exemplary aspects, the expression level is measured within 1, 4, 6, 8, 12, 16, or 24 hours of obtaining the sample. In exemplary aspects, the sample is cryopreserved and expression of the sample is determined at a later time.

In exemplary aspects, the methods comprise processing the sample for measurement of expression. For example, the methods may comprise RNA isolation from cells of the scaffold. The methods may comprises homogenizing in a Trizol reagent for RNA isolation or in a detergent for protein isolation. In exemplary aspects, it is desirable to fractionate the cells of the sample into cell type specific sub-populations. In this regard, the methods comprise in exemplary instances a step for separating the cells of the scaffold into cell type specific sub-populations. In exemplary aspects, the cells of the scaffold are separated into subpopulations of immune cells and stromal cells. In exemplary instances, the cells of the scaffold are separated into fibroblasts, endothelial cells, dendritic cells, CD45+ cells, T-cells, B-cells, monocytes, macrophages, MDSCs, neutrophils, and natural killer cells. In exemplary aspects, the methods comprise measuring or quantifying the different cell populations in the sample, in addition to or instead of measuring a level of expression of a gene, an RNA or a protein, in a sample obtained from a niche in the subject. In exemplary aspects, the methods comprise determining the cell population profile of the sample. In exemplary aspects, the methods comprises determining the cell signature of the sample. Methods of measuring cell populations in a sample may be performed by known techniques, including, fluorescent-assisted cell sorting (FACS), magnetic-assisted cell sorting, histological techniques, e.g., fluorescent immunohistochemistry or multiplexed fluorescent imaging technologies. In exemplary aspects, the methods comprise monitoring the cell populations over time.

In exemplary aspects, the method comprises measuring an expression level of the sample in more than one way. In exemplary instances, the methods comprise measuring expression using a gene chip and an ELISA or other immunoassay. In exemplary instances, the methods comprise measuring expression levels of one or more housekeeping genes and comparing the measured levels of genes to housekeeping genes. In exemplary aspects, the methods comprises normalizing the expression level data to expression levels of one or more housekeeping genes.

In exemplary aspects, when the method comprises, e.g., measuring a level of expression of a plurality of genes, RNA, and/or proteins, the methods comprise constructing a matrix of expression levels, e.g., a matrix of gene expression levels, a matrix of RNA expression levels, a matrix of protein expression levels. The matrices can be further categorized into biological pathways or functions, e.g., a sub-matrix of genes, RNA, and/or proteins involved in cell cycle control, immune cell proliferation and activation, inflammation, immune checkpoint regulation, removal of immune components directed to self-antigens, or a sub-matrix for extracellular matrix (ECM) components. The matrices may be manipulated to remove data points or add data points from a second source of data, an ELISA vs. a multiplex bead-based assay. The expression levels of the matrices may be normalized to housekeeping genes and/or to total protein concentrations. In exemplary aspects, the methods comprise analyzing the expression level matrices for expression level changes, significance, false-detection rate of key variables, and for the identification of analytes of particular interest via regularization, supervised discriminate analysis (e.g., using Lasso or Elastic Net; Partial Least-Squares Discriminate Analysis (PLS-DA); feature selection).

In exemplary aspects, the matrices are compressed into a single metric or score. In exemplary aspects, such decompression of multiple variables into a single metric or score is accomplished via linear combination of multiple gene or protein expression levels, singular value decomposition (SVD), dynamic mode decomposition (DMD), principle component analysis (PCA), or Fisher linear discriminant. Methods of SVD for similar purposes are described in Alter et al., Proc Natl Acad Sci USA. 2000 Aug. 29; 97 (18): 10101-10106.

In exemplary aspects, a machine learning algorithm is employed to attain a prediction of AID state or status. The algorithm may comprise one or more of logistic regression, discriminant analysis (linear or quadratic), RANDOM FOREST™ generation or other ensemble/decision tree classification, neural networks pattern recognition (hidden layers), support vector machines, nearest neighbor (fine-course weighted) and Bayesian networks.

In exemplary aspects, the method comprises providing to the subject a treatment or therapy purposed for treating the AID. The treatment or therapy purposed for treating the AID may be any of those known in the art or described herein. In exemplary instances, the AID treatment comprises any of those described herein or known in the art. In exemplary aspects, the treatment comprises administration of one or more agents which reduce inflammation or suppress the immune system.

In exemplary aspects, the method further comprises combining multiple metrics into a multivariate signature. This step may comprise combining multiple scoring and prediction algorithms to a graphical or numerical output for identification of trends, correlations and outliers. Visual outputs for correlation include side by side box or bar plots for each algorithm or a combination thereof into a multidimensional output (e.g., multivariable plot of SVD score and RF prediction). Example figures show the SVD score plotted on the x-axis and the RF prediction plotted on the y-axis. This outline is flexible. The general concept is to establish a parameter space composed of these multivariate metrics with high and low end to aid categorization of test samples.

Further details relating to data processing are provided below.

Data Processing

The present techniques further include measuring levels of the genes, RNA, or proteins and determining an expression signature for a subject using a processing system. For example, in exemplary embodiments, an AID is monitored, detected, diagnosed, or staged by measuring a level of expression of a gene, a RNA or a protein, or a combination thereof, in a sample obtained from a niche at the implantation site of a synthetic scaffold in a subject. In exemplary embodiments, a level of expression of a plurality of genes, RNA, and/or proteins, are measured. The measured expression level data are then provided to a processing system that compares the measured expression level data to control levels of the expression data. In some exemplary embodiments, the processing system compares measured expression level data of a first time instance to measured expression level data taken at a second time instance, or to a plurality of time instances. In exemplary aspects, the first time point occurs before a treatment and the second time point occurs after a treatment and the method is a method of determining the efficacy of a treatment for AID.

The processing system may compare measured expression level data using different algorithm-based analyses subsystems. In some examples, one type of subsystem employs a compression algorithm, such as a single value decomposition (SVD) algorithm that receives a plurality of different measured expression level data and compresses that data into a single scoring metric. In some examples, one type of subsystem employs a probability determination, such as a decision tree classification (e.g. RANDOM FOREST™) algorithm, that indicates a probability of AID progression or regression. In some examples, that probability indicates a subject's status of AID, e.g., stage of AID.

An example implementation of the processing system to determine an expression signature for a subject is as follows.

At an initial processing stage, synthetic scaffold implantation is performed, followed by retrieval. An implant polymer scaffold, in accordance with the teachings herein and other example scaffolds including those described above is inserted into a subject, such as a predetermined high-risk subject, prior to disease onset. The implant is then used for early detection of AID. In some examples, implantation occurs following therapeutic intervention and is used for monitoring therapeutic efficacy.

At the time point of interest, e.g., after a given number of days or after a therapeutic intervention, a biopsy is performed to remove the scaffold, either surgically removal of the entire scaffold or removal of only a portion thereof, such as performing a core-needle biopsy of the scaffold microenvironment.

With the scaffold removed or a sample of the niche of the scaffold removed, the scaffold contents are processed for molecular content determination. In some examples, such processing includes isolate RNA and/or protein from scaffold biopsy (e.g., homogenize in Trizol reagent or detergent, respectively). Optionally, in some examples, fractionate cell populations within the scaffold for cell type specific analysis may be performed. While cell population analysis techniques will be understood, in some examples, separate cell populations based on fluorescent-assisted cell sorting or magnetic-assisted cell sorting may be performed. Analysis of gene or protein expression may be achieved, in some examples, using either qRT-PCR or RNAseq, for gene expression, and either ELISA or Luminex (bead-based multiplex assays), for protein expression. The result from this initial processing stage is measured expression level data that is provided to a processing system.

Figures 3, 4A, 4B:
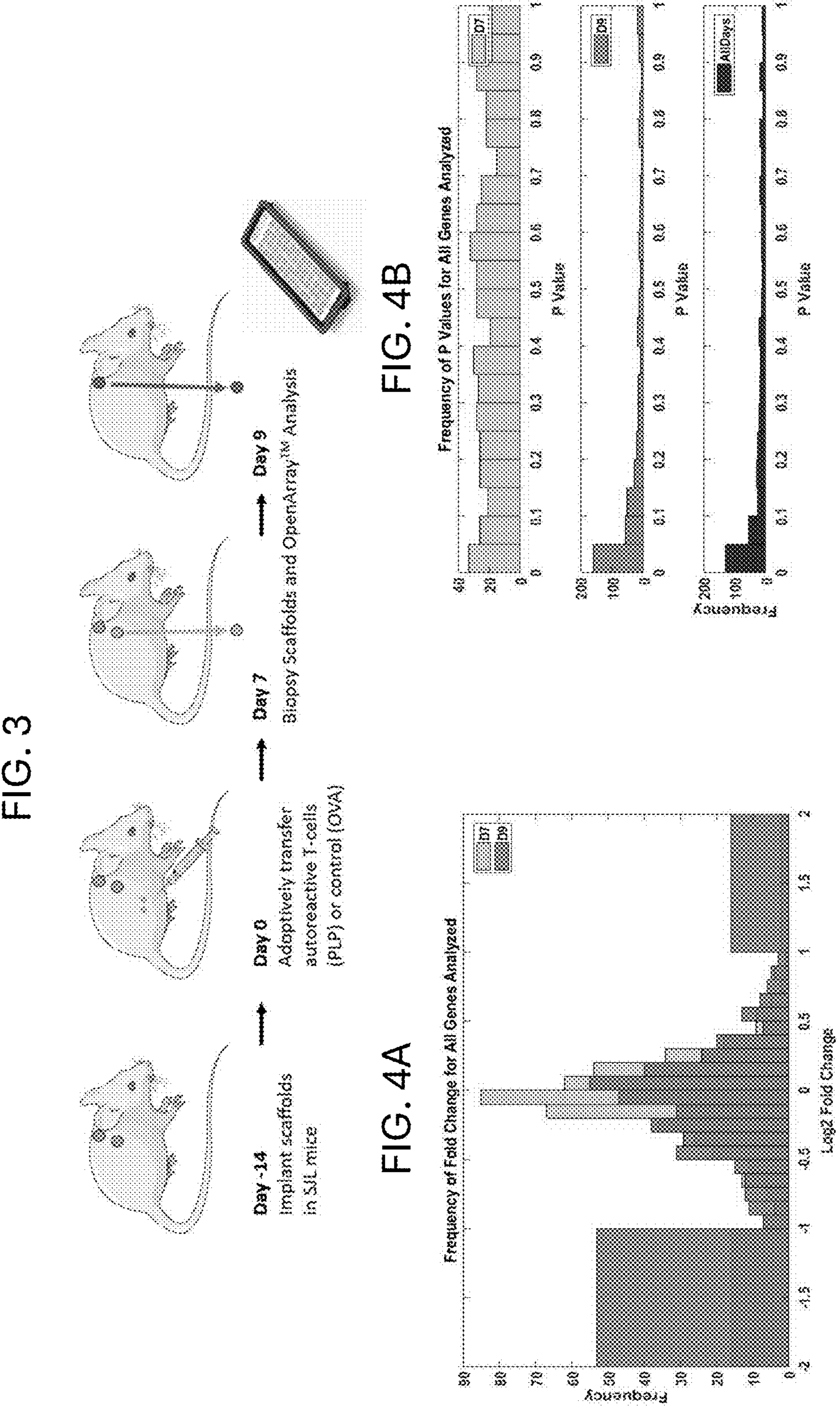
FIG. 3 is an illustration of the experimental procedure carried out in Example 3.
FIG. 4A is a graph depicting the frequency of fold change for all genes analyzed as a function of fold change (log 2 fold change). Data shows the frequency of change for the transcriptome of the scaffold on Day 7 and the frequency of change for the transcriptome of the scaffold on Day 9.
FIG. 4B is a series of graphs demonstrating that the transcriptome changes occur both pre-symptomatically (at Day 7) and during clinical onset (at Day 9).

At a next stage, measured expression level data is preprocessed in the processing system. In exemplary embodiments, the processing system analyzes the measured expression level data and performs an alignment of various analytes into a format for either signature development or test sample characterization. The alignment may be in the form of a matrix with or without categorical indicators, for example. An example output of fold change from a significance from a compiled matrix is shown in FIG. 4A.

The processing system may include numerous pre-processing data analysis and correction processes. For example, compensation for missing data points may be used depending upon the computational algorithm chosen to perform the alignment. Furthermore, removal of an entire analyte may be used, if too many data points are missing or a nearest neighbor average may be employed, if cohort size is suitable.

For gene expression, the processing system may perform gene stability analysis and normalization. For example, a panel of genes may be compared against each other for stability within the set then a subset may be determined for sample normalization.

For protein expression, the processing system may normalize total sample protein concentration.

Further pre-processing by the processing system may include, analyzing fold change, significance, and false-detection rate of key variables for interpretation of single analyte dynamics.

The processing system, with the foregoing pre-processing, then identifies analytes (gene or protein expression) of interest, for example, via regularization or supervised discriminate analysis. Techniques that may be used include a Lasso or Elastic Net process and/or a Partial-Least Squares Discriminate Analysis (PLS-DA).

At a next stage, a reduction of the variables from the second stage is performed to determine a single metric, i.e., a compressed metric of the measured expression level data.

In exemplary embodiments, a process of decomposition matrix of gene expressions is performed and a gene expression score is attained. An example decomposition matrix is a singular value decomposition (SVD) process. In an example implementation, a single score was obtained by the processing system from the first left singular vector, which forms an orthonormal basis for the assay expression profiles. An examples decomposition matrix that may be used is a dynamic mode decomposition (DMD).

With a decomposition performed on the measured expression level data, the processing system may be further configured to employ a machine learning process to attain a prediction of disease state. An example, machine learning process is a RANDOM FOREST™ (RF) generation or other ensemble/decision tree classification algorithm. In some examples, the machine learning process employs a logistic regression analysis. In some examples, the machine learning process employs a discriminant analysis (linear or quadratic). In some examples, the machine learning process employs a support vector machines analysis. In some examples, the machine learning process employs a nearest neighbor (fine-course, weighted) analysis.

Figures 8, 9:
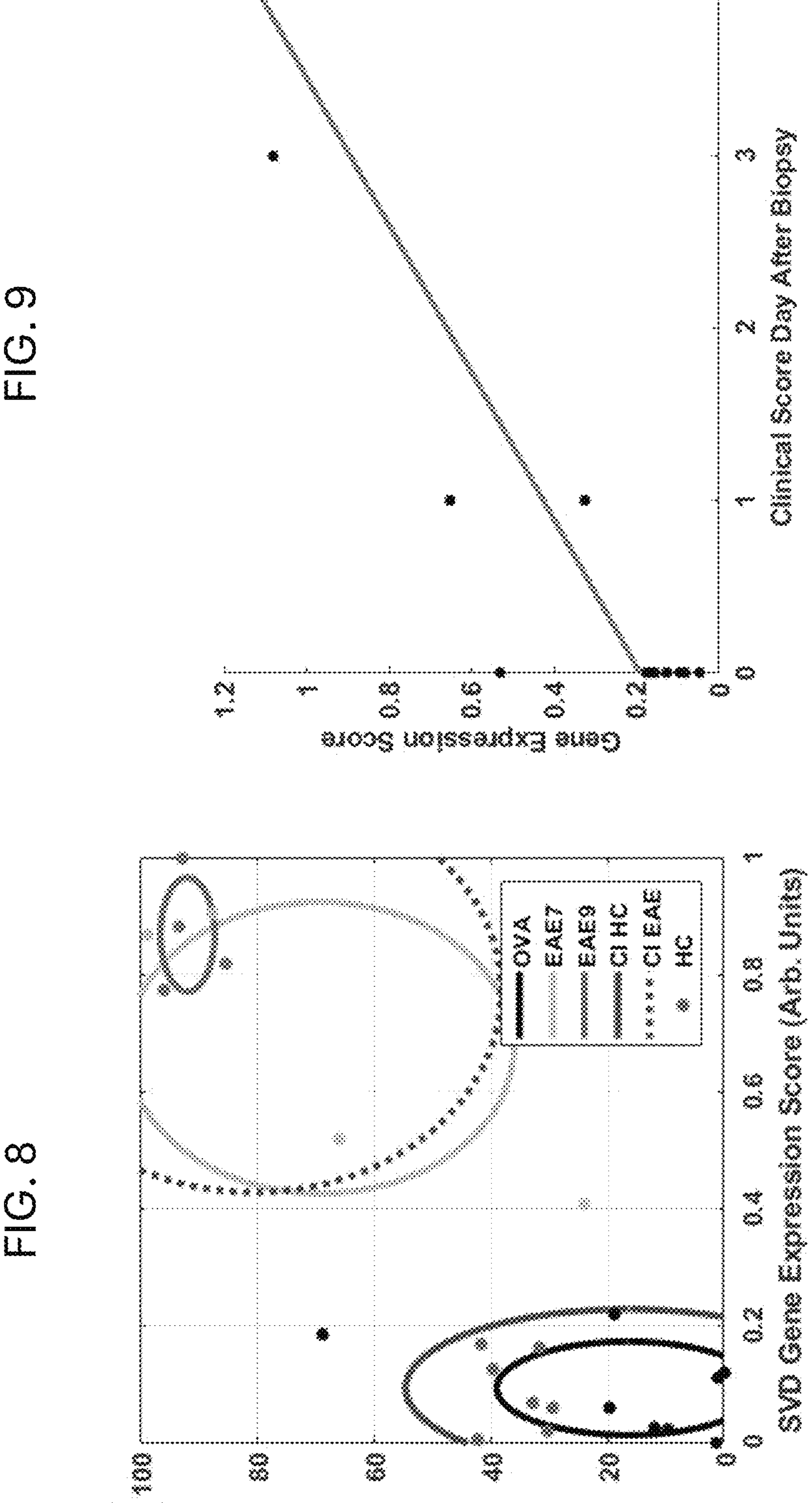
FIG. 8 is a multivariate signature plot of the RF model prediction vs SVD demonstrating that EAE mice very clearly separates from OVA controls.
FIG. 9 is a graph of the single numeric Score plotted as a function of clinical score the day after biopsy. $R2>0.9$.
Figure 13:
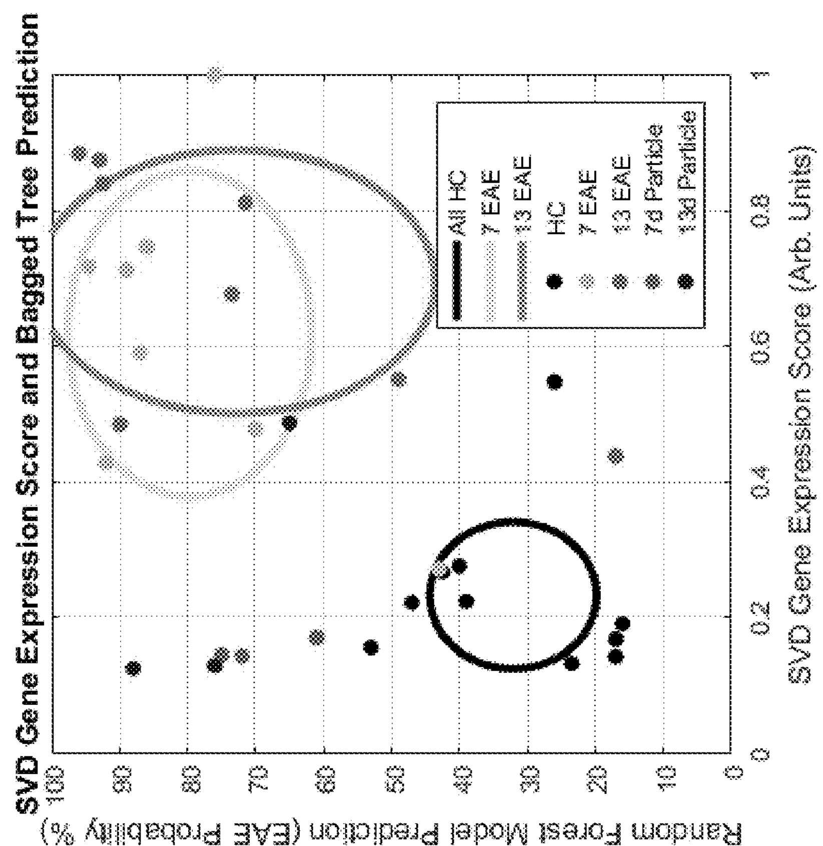
FIG. 13 is a graph of the RANDOM FOREST™ score plotted versus SVD. Ovals represent 99.9% CI for indicated time points and individual points represent scores assigned to scaffolds from individual animals.

At a next stage, a combination is performed on multiple scores and a predicted AID status is determined. In an exemplary embodiment, the SVD score and the decision tree classification algorithm percentage prediction are combined to analyze the measured expression level data in a multidimensional process. For example, the SVD score and the decision tree classification algorithm percentage prediction may be combined into an interrelation plot showing a multivariate analysis. In some examples, the two may be combined to form a numerical output. In either example, the multidimensional process may be used by the processing system to identify trends, correlations, and outliers and to assess pre AID. FIGS. 2C, 8, and 13 illustrate an example multivariate plot that may be generated and displayed by the processing system. The plot provides a visual indication of the outputs for correlation of the SVD and RANDOM FOREST™ values, including side by side box or bar plots for each algorithm or a combination of algorithms into a multidimensional output (e.g., scatter plot of SVD score and RF prediction).

In exemplary aspects, as described above, the measured levels of the genes, RNA, or proteins form a gene expression signature, an RNA expression signature, or a protein expression signature, respectively. In further aspects, the measurement of cell types in the sample form a cell signature.

In exemplary instances, each of the signatures are processed into a single value. In various aspects, the measured levels of the genes, RNA, or proteins form an expression signature and the expression signature is processed through a decomposition algorithm to obtain a single score for gene expression and/or a machine learning algorithm to obtain a score of prediction of disease state. In various aspects, the decomposition algorithm is a singular value decomposition and/or the machine learning algorithm is a decision tree classification algorithm (e.g. RANDOM FOREST™) prediction model. In certain instances, the expression signature is processed through a decomposition algorithm to obtain a single score for gene expression and a machine learning algorithm to obtain a score of prediction of disease state. In exemplary aspects, the single score for gene expression and the score of prediction of disease state are combined to provide a combined score of autoimmune disease status. As used herein, the term “autoimmune disease status” or “AID status” is synonymous with AID stage.

In exemplary instances, the control level(s) of the gene(s), RNA, or protein(s) is/are level(s) of a subject known to have an autoimmune disease. In exemplary instances, the control levels of the genes, RNA, or proteins form a control expression signature indicative of an autoimmune disease, optionally, the control expression signature indicative of autoimmune disease is processed through a decomposition algorithm to obtain a single score for gene expression and/or a machine learning algorithm to obtain a score of prediction of disease state. In various aspects, the decomposition algorithm is a singular value decomposition and/or the machine learning algorithm is a decision tree classification algorithm (e.g. RANDOM FOREST™) prediction model. In some instances, the control expression signature is processed through a decomposition algorithm to obtain a single control score for gene expression and a machine learning algorithm to obtain a control score of prediction of disease state. In exemplary aspects, the single control score for gene expression and the control score of prediction of disease state are combined to provide a combined control score, optionally, the combined score of AID status is compared to the combined control score to determine the subject's autoimmune disease status.

In various aspects, the control level(s) of the gene(s), RNA, or protein(s) is/are level(s) of a subject known to not have an AID. In exemplary instances, the control levels of the genes, RNA, or proteins form a control expression signature indicative of no AID, optionally, the control expression signature is processed through a decomposition algorithm to obtain a single score for gene expression and/or a machine learning algorithm to obtain a score of prediction of disease state. In various aspects, the decomposition algorithm is a singular value decomposition and/or the machine learning algorithm is a decision tree classification algorithm (e.g. RANDOM FOREST™) generation. In various aspects, the control expression signature is processed through a decomposition algorithm to obtain a single control score for gene expression and a machine learning algorithm to obtain a control score of prediction of disease state. Optionally, the single control score for gene expression and the control score of prediction of disease state are combined to provide a combined control score. In some aspects, the combined score of AID status is compared to the combined control score to determine the subject's AID status. In various instances, when the combined score of AI disease status is low, relative to the combined control score, the subject's AID status is low and/or the subject is deemed healthy or in remission, when the combined score of AID status is intermediate, relative to the combined control score, the subject's AID status indicates an early stage of AID or pre-symptomatic or imminent symptomatic onset or relapse, and when the combined score of AID status is high, relative to the combined control score, the subject's AID status indicates ongoing symptomatic AID. Optionally, when the combined score of AID status is intermediate, relative to the combined control score, the subject's AID status indicates an early stage of AID or intermediate severity, and the subject is determined as needing an AID treatment comprising corticosteroids or another standard of care that is meant to limit neuroinflammation and/or when the combined score of AID status is high, relative to the combined control score, the subject's AID status indicates AID, and the subject is determined as needing an AID treatment, optionally, wherein the AID treatment plasmapheresis, corticosteroids, Alemtuzumab, fingolimod, IFN-beta, natalizumab, glatiramer acetate, ocrelizumab, dimethyl fumarate, teriflunomide, or mitoxantrone, or a combination thereof. Moreover, patients with high scores may also be treated with plasmapheresis (plasma exchange). Collectively, the scoring system presents a metric for informing the therapy administered, and early detection may enable preemptive administration.

Figure 15:
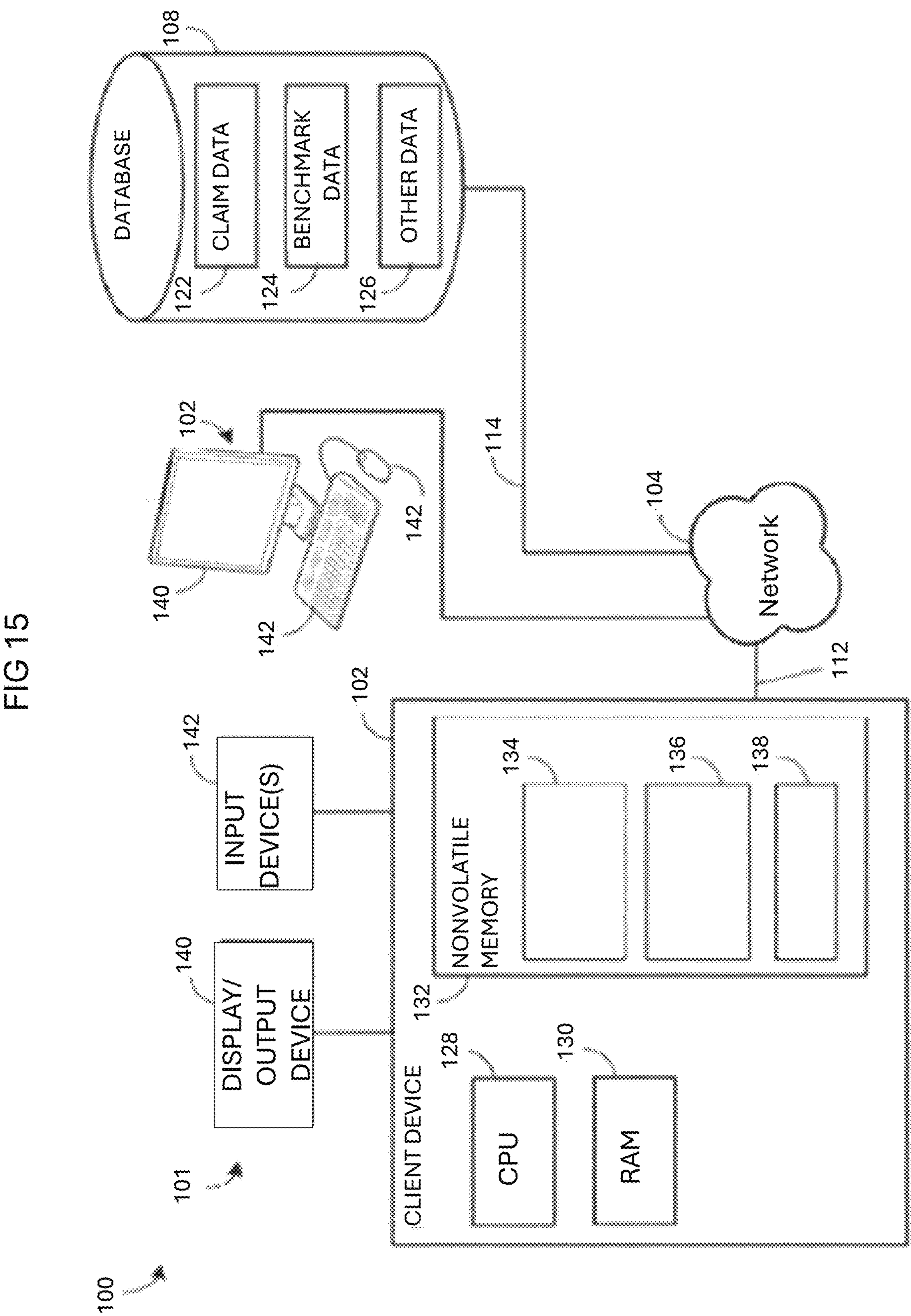
FIG. 15 is a system diagram of a processing system for performing the techniques described herein, including, assessing a subject's metastatic potential, in accordance with an example.
Figures 16C, 16D:
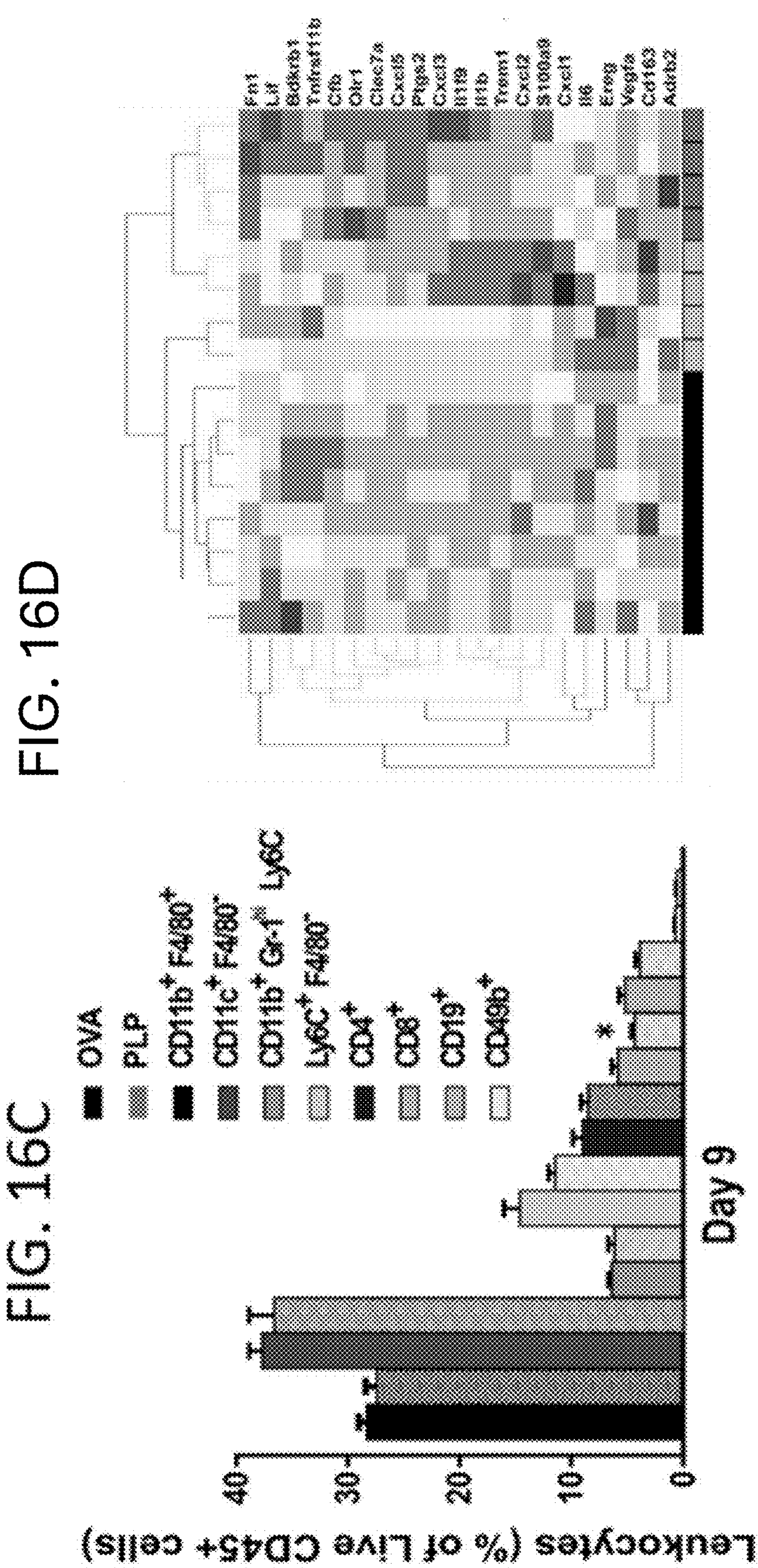
Figure 16E:
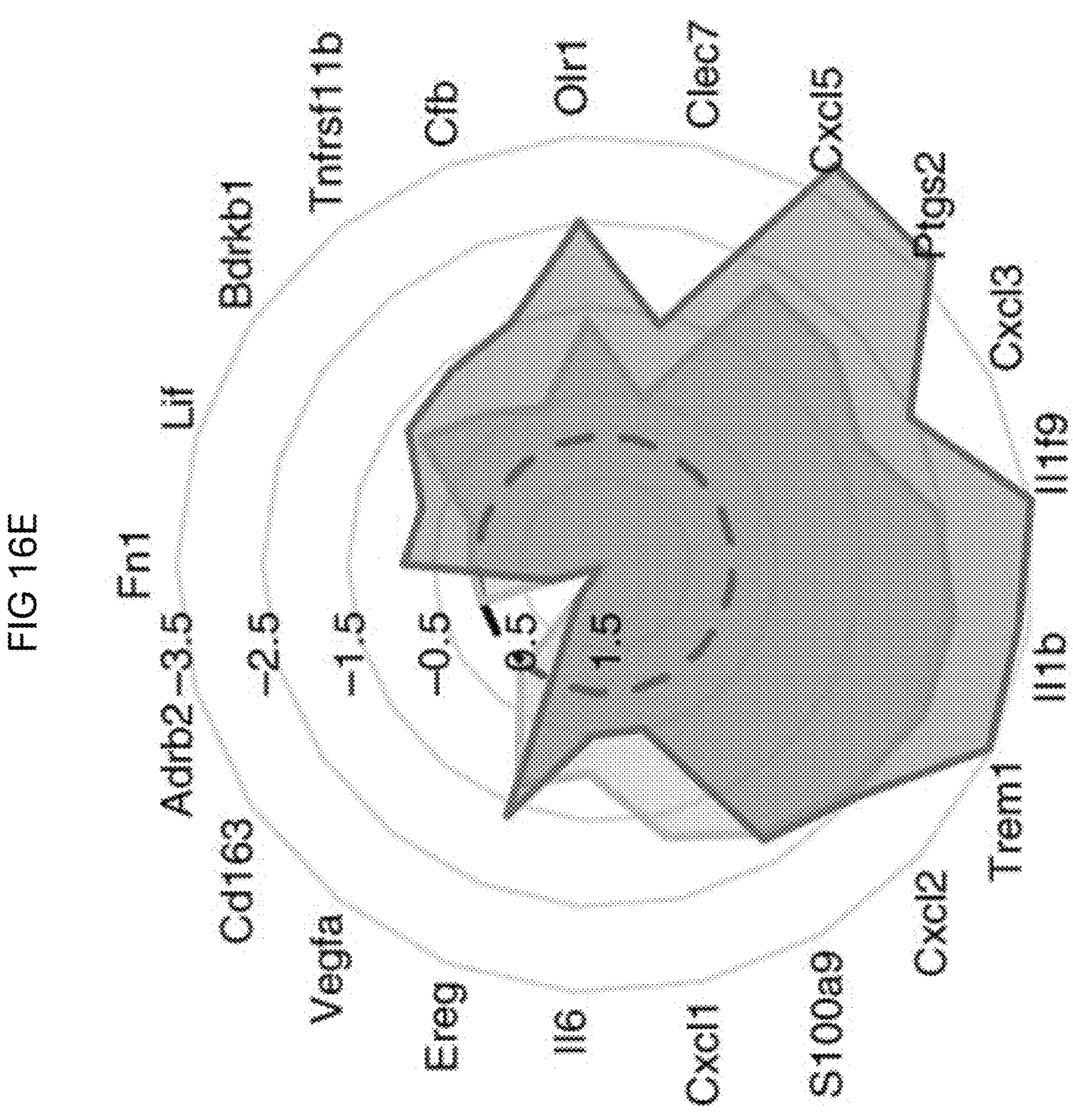
Figure 16F:
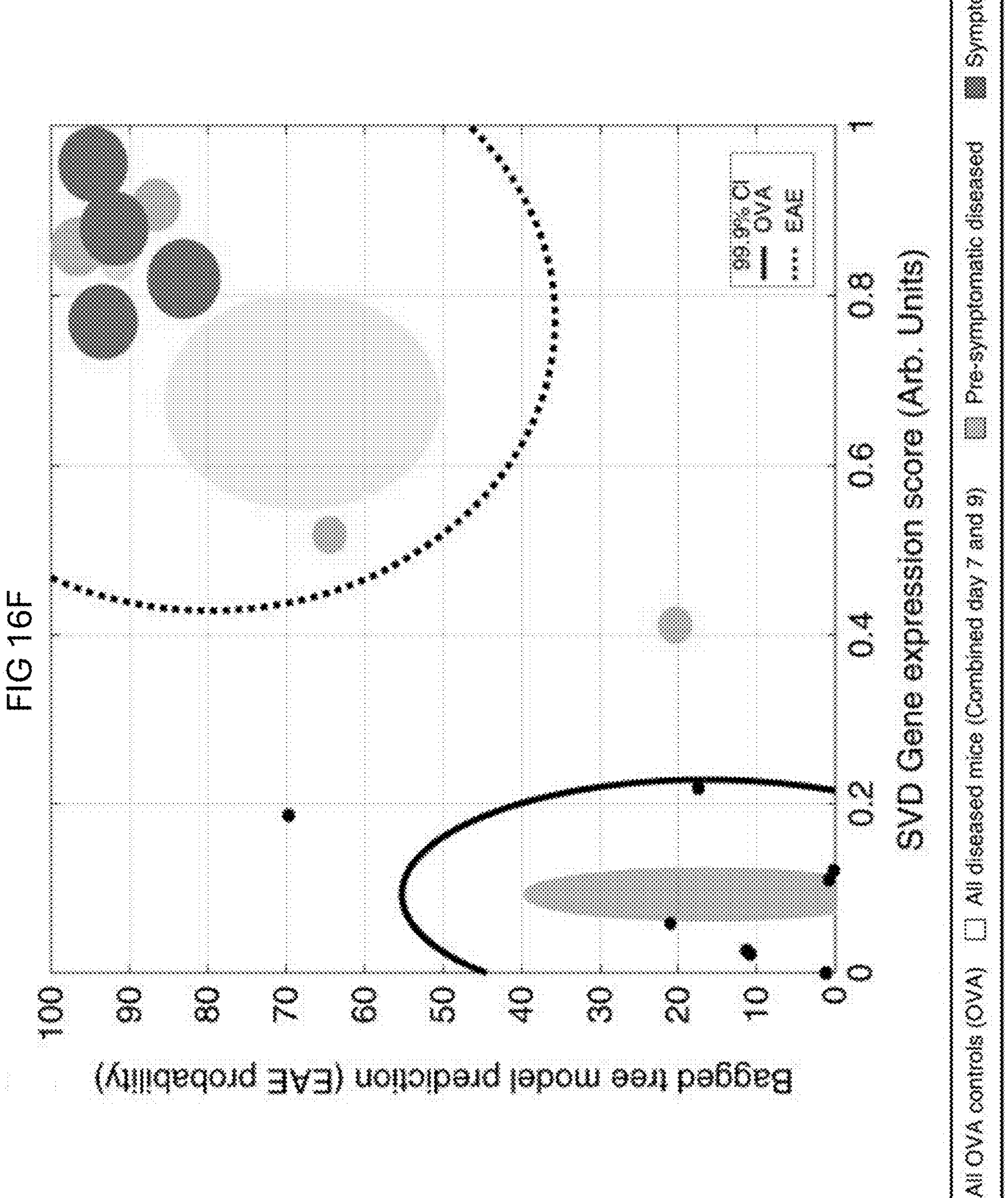
Figure 16G:
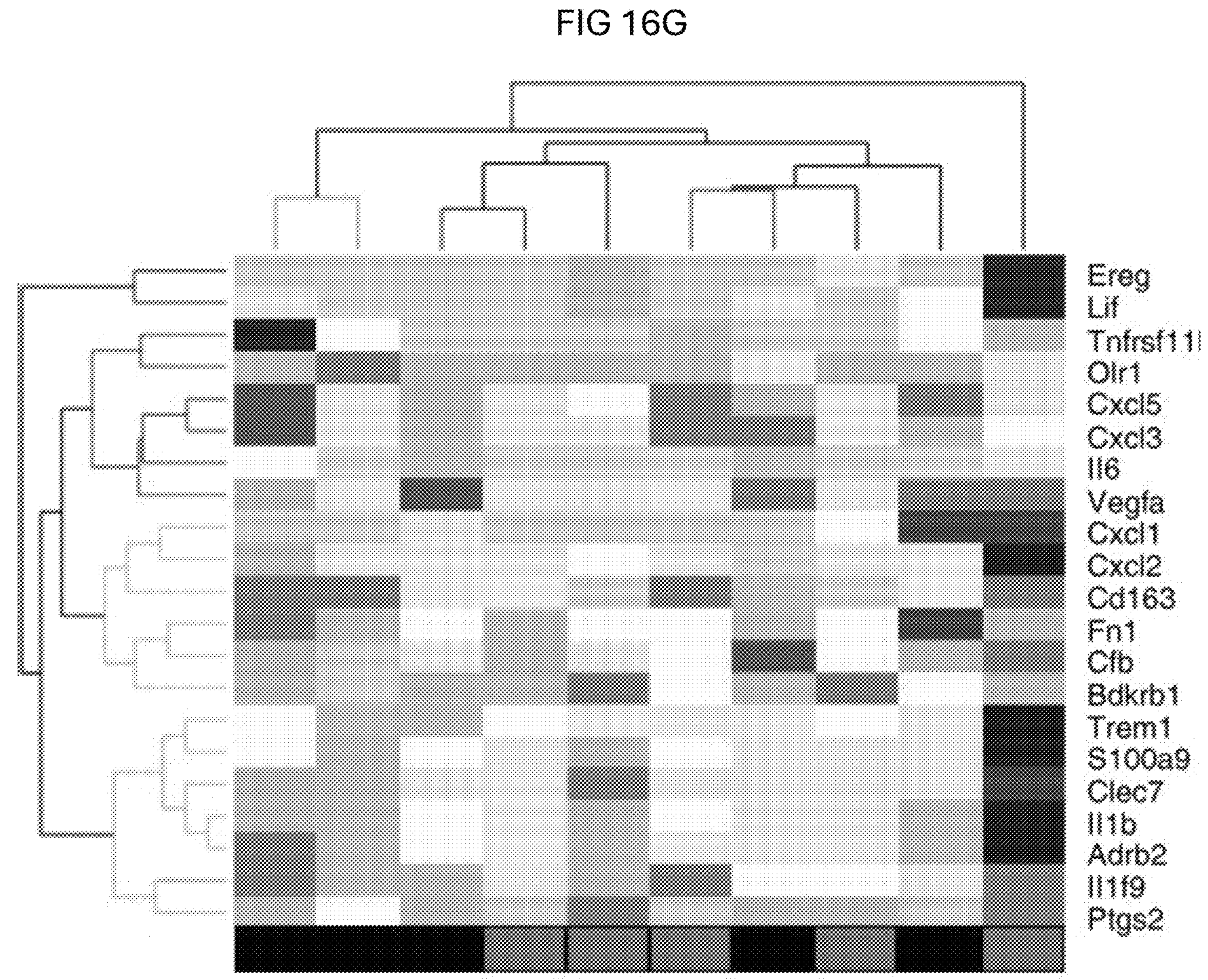
Figure 16H:
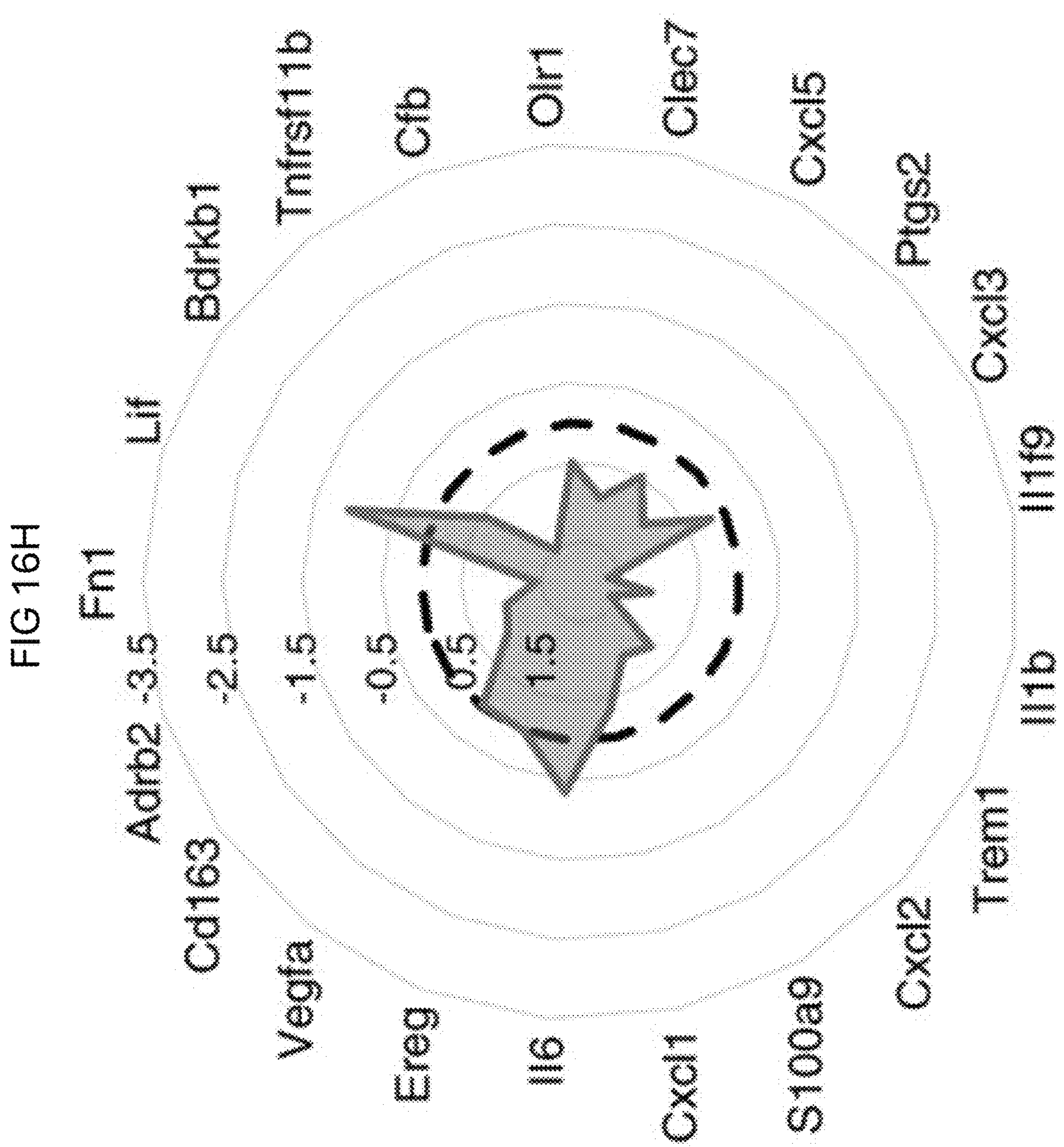
Figures 17A, 17B:
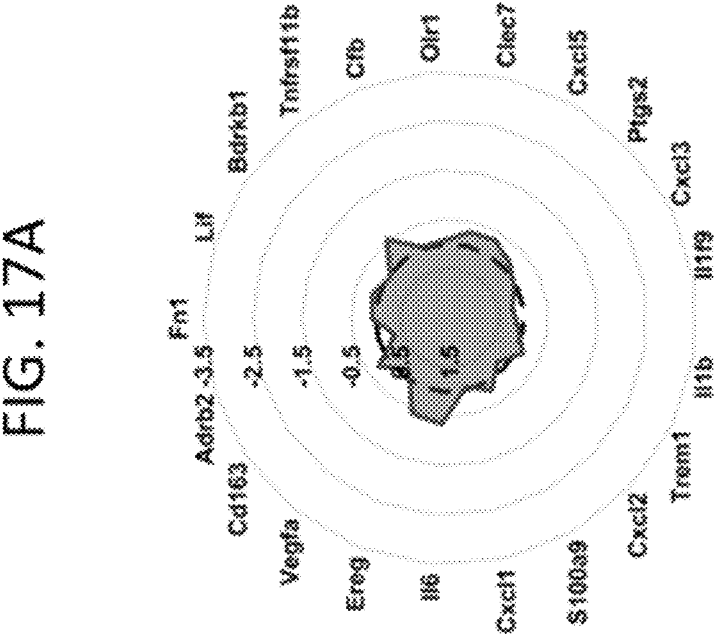
FIGS. 17A-17F demonstrate Gene signature in IN effectively monitors disease dynamics and indicates relapse. For relapse studies, INs were implanted subcutaneously two weeks before disease induction by adoptive transfer. INs were isolated at day 21 (remission) and day 28 (relapse). Mice received a second adoptive transfer of T cells (either $PLP_{178-191}$ or SIINFEKL) on day 23 to induce relapse (indicated on graphs with black arrows).
Figure 17C:
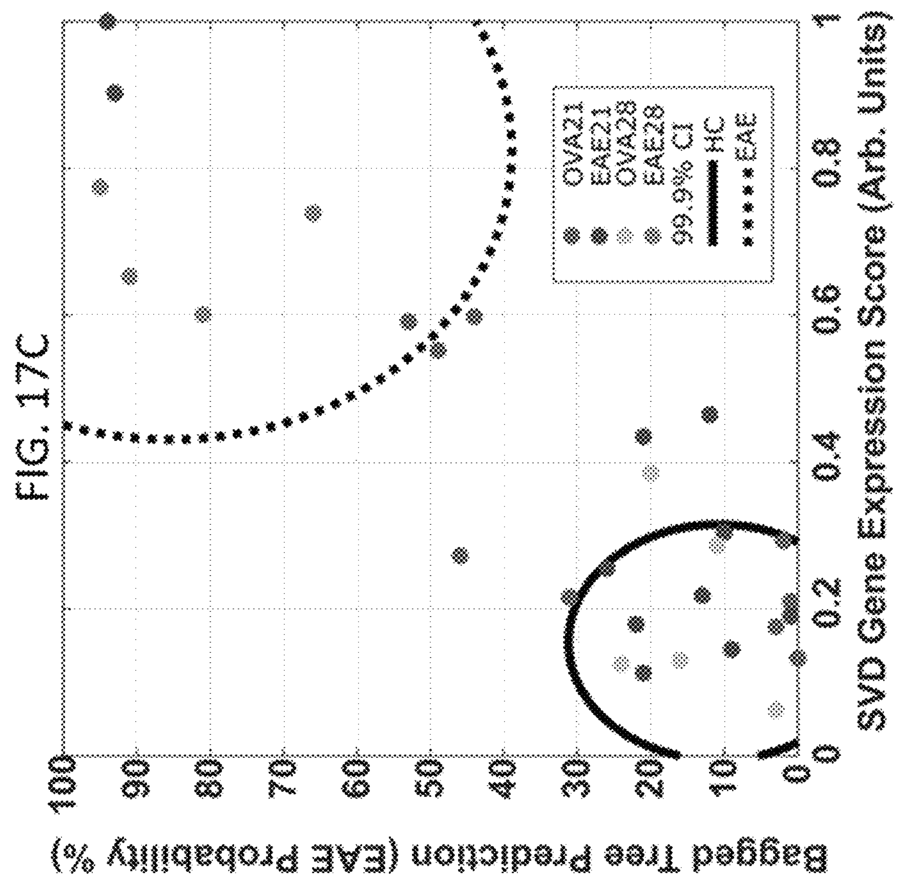
Figures 17D, 17E, 17F:
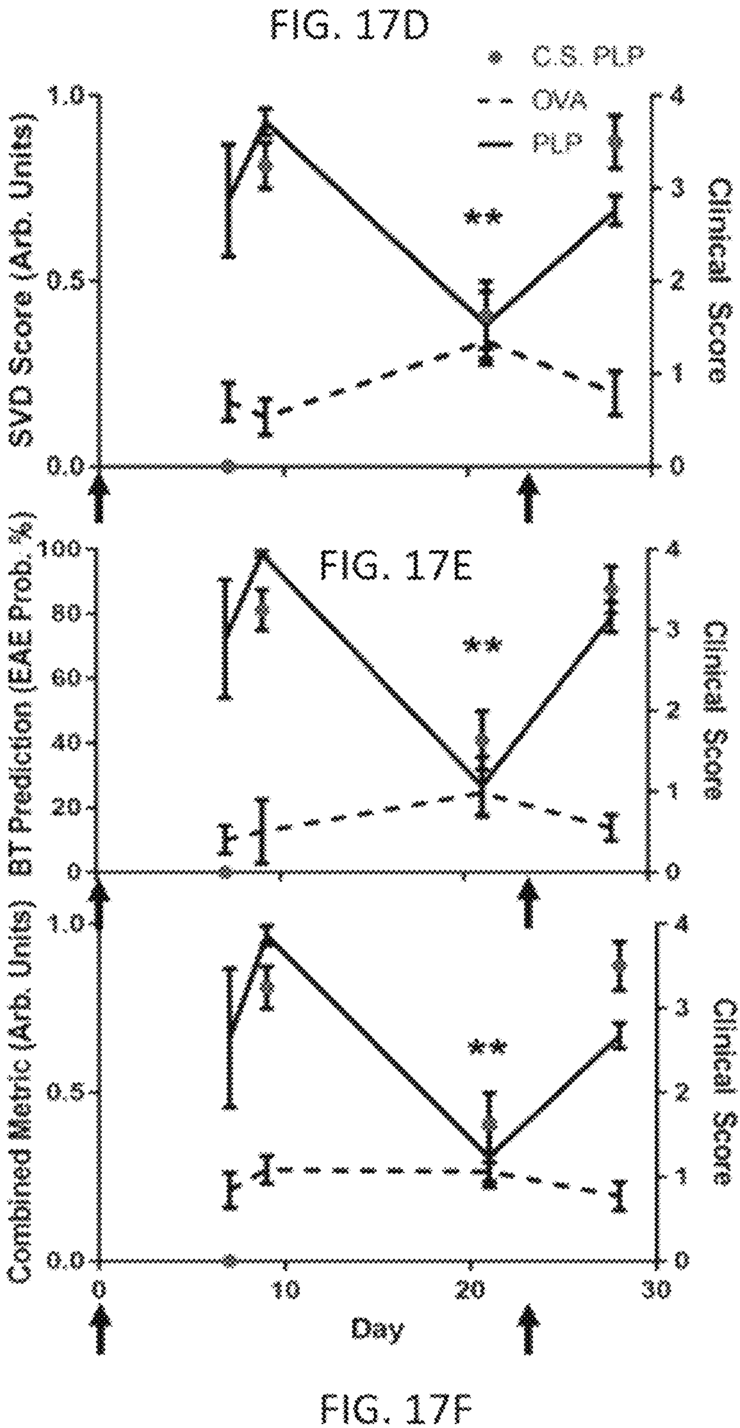
Figures 18A, 18B:
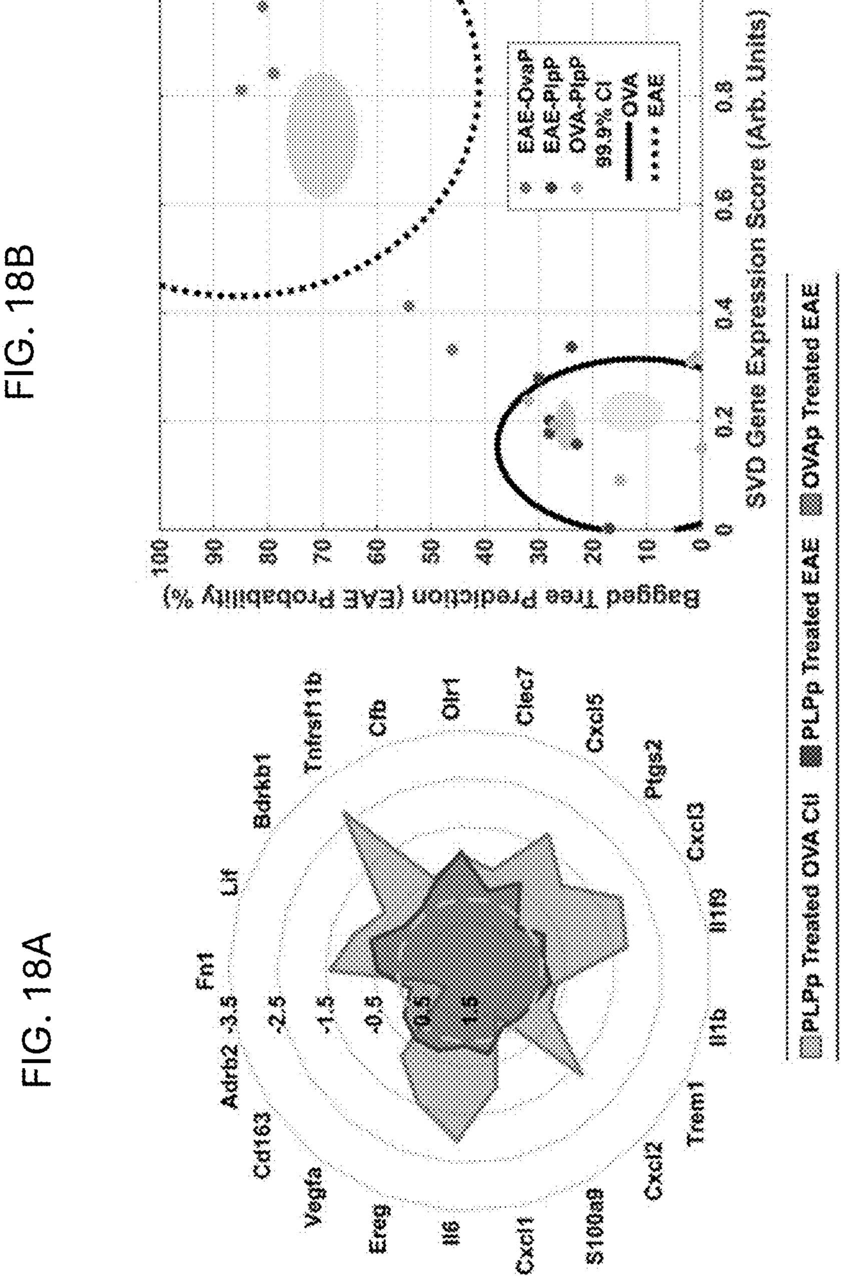
FIGS. 18A-18C demonstrate Gene signatures indicate response to therapy and enable proactive treatment to prevent disease. To test the ability of the IN to indicate response to therapy, 2.5 mg PLG nanoparticles encapsulating either PLP or OVA peptides were administered I.V. two days after adoptive transfer and INs were isolated on day 9 (disease onset).
Figure 18C:
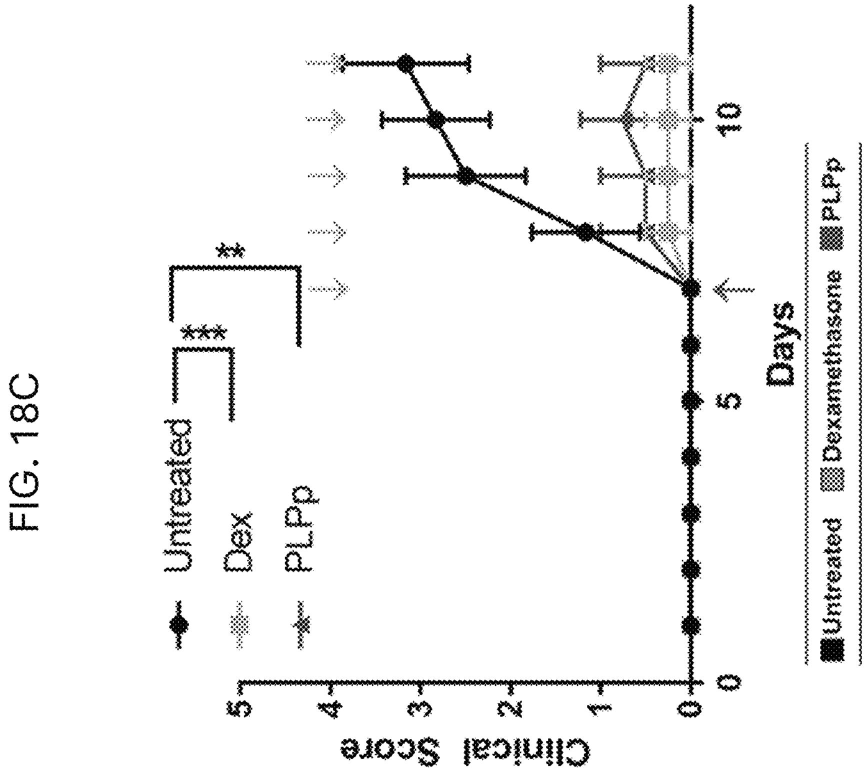

Systems, Computer-Readable Storage Media, and Methods Implemented by a Computer Processor FIG. 15 illustrates an exemplary embodiment 101 of a system 100 for determining a subject's status of AID. Generally, the system 100 may include one or more client devices 102, a network 104, and a database 108. Each client device 102 may be communicatively coupled to the network 104 by one or more wired or wireless network connections 112, which may be, for example, a connection complying with a standard such as one of the IEEE 802.11 standards ("Wi-Fi"), the Ethernet standard, or any other appropriate network connection. Similarly, the database 108 may be communicatively coupled to the network 104 via one or more connections 114. (Of course, the database could alternatively be internal to one or more of the client devices 102.) The database 108 may store data related to the expression profiles for a variety of subjects, including, but not limited to, data of a sample obtained from a scaffold implanted in the subject, data of a sample obtained from a scaffold implanted in a control population, etc. In exemplary aspects, the control is a population of subjects known to not have an AID. In exemplary aspects, the control is a population of subjects known to have a pre-symptomatic form of AID. In exemplary aspects, the control is a population of subjects known to have symptomatic form of AID.

The data of the samples may be, for example, related to one or more of a level of expression of one of the following genes: Il1b, Tnfrsf11b, Cxcl5, Cd163, VEGFa, or an RNA or protein encoded thereby, or one or more of the genes of Group I, II, and/or III.

As will be understood, the network 104 may be a local area network (LAN) or a wide-area network (WAN). That is, network 104 may include only local (e.g., intra-organization) connections or, alternatively, the network 104 may include connections extending beyond the organization and onto one or more public networks (e.g., the Internet). In some embodiments, for example, the client device 102 and the database 108 may be within the network operated by a single company (Company A). In other embodiments, for example, the client device(s) 102 may be on a network operated by Company A, while the database 108 may be on a network operated by a second company (Company B), and the networks of Company A and Company B may be coupled by a third network such as, for example, the Internet.

Referring still to FIG. 15, the client device 102 includes a processor 128 (CPU), a RAM 130, and a non-volatile memory 132. The non-volatile memory 132 may be any appropriate memory device including, by way of example and not limitation, a magnetic disk (e.g., a hard disk drive), a solid state drive (e.g., a flash memory), etc. Additionally, it will be understood that, at least with regard to FIG. 16, the database 108 need not be separate from the client device 102. Instead, in some embodiments, the database 108 is part of the non-volatile memory 132 and the data 122, 124, 126 may be stored as data within the memory 132. For example, the data 122 may be included as data in a spreadsheet file stored in the memory 132, instead of as data in the database 108. In addition to storing the records of the database 108 (in some embodiments), the memory 132 stores program data and other data necessary to analyze data of one or more sample and/or control populations, etc. For example, in an embodiment, the memory 132 stores a first routine 134, a second routine 136, and a third routine 138. The first routine 134 may receive data values related to a measured expression level of a gene, RNA, or protein of a sample obtained from a scaffold implanted in a test subject, and may process the data values received by the routine 134 through an algorithm to obtain a score. The second routine 136 may computer one or more statistical parameters of the data collected by the first routine 134, such as determining a mean value, a standard deviation value, etc. Additionally and/or alternatively, the second routine 136 may plot a score on a graphical or numerical output. Regardless, each of the routines is executable by the processor 128 and comprises a series of compiled or compilable machine-readable instructions stored in the memory 132. Additionally, the memory 132 may store generated reports or records of data output by one of the routines 134 or 136. Alternatively, the reports or records may be output to the database 108. One or more display/output devices 140 (e.g., printer, display, etc.) and one or more input devices 142 (e.g., mouse, keyboard, tablet, touch-sensitive interface, etc.) may also be coupled to the client device 102, as is generally known.

As will be understood, although individual operations of one or more methods are illustrated and described as separate operations, one or more of the individual operations may be performed concurrently, and nothing requires that the operations be performed in the order illustrated. Structures and functionality presented as separate components in example configurations may be implemented as a combined structure or component. Similarly, structures and functionality presented as a single component may be implemented as separate components. These and other variations, modifications, additions, and improvements fall within the scope of the subject matter herein.

For example, the network 104 may include but is not limited to any combination of a LAN, a MAN, a WAN, a mobile, a wired or wireless network, a private network, or a virtual private network. Moreover, while only two clients 102 are illustrated in FIG. 15 to simplify and clarify the description, it is understood that any number of client computers are supported and can be in communication with one or more servers (not shown).

Additionally, certain embodiments are described herein as including logic or a number of routines. Routines may constitute either software routines (e.g., code embodied on a machine-readable medium or in a transmission signal) or hardware routines. A hardware routine is tangible unit capable of performing certain operations and may be configured or arranged in a certain manner. In example embodiments, one or more computer systems (e.g., a standalone, client or server computer system) or one or more hardware routines of a computer system (e.g., a processor or a group of processors) may be configured by software (e.g., an application or application portion) as a hardware routine that operates to perform certain operations as described herein.

Similarly, the methods or routines described herein may be at least partially processor-implemented. For example, at least some of the operations of a method may be performed by one or processors or processor-implemented hardware modules. The performance of certain of the operations may be distributed among the one or more processors, not only residing within a single machine, but deployed across a number of machines. In some example embodiments, the processor or processors may be located in a single location (e.g., within a home environment, an office environment or as a server farm), while in other embodiments the processors may be distributed across a number of locations.

The performance of certain of the operations may be distributed among the one or more processors, not only residing within a single machine, but deployed across a number of machines. In some example embodiments, the one or more processors or processor-implemented modules may be located in a single geographic location (e.g., within a home environment, an office environment, or a server farm). In other example embodiments, the one or more processors or processor-implemented modules may be distributed across a number of geographic locations.

Some embodiments may be described using the expression "coupled" and "connected" along with their derivatives. For example, some embodiments may be described using the term "coupled" to indicate that two or more elements are in direct physical or electrical contact. The term "coupled," however, may also mean that two or more elements are not in direct contact with each other, but yet still co-operate or interact with each other. The embodiments are not limited in this context.

As used herein, the terms "comprises," "comprising," "includes," "including," "has," "having" or any other variation thereof, are intended to cover a non-exclusive inclusion. For example, a process, method, article, or apparatus that comprises a list of elements is not necessarily limited to only those elements but may include other elements not expressly listed or inherent to such process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

In addition, use of the "a" or "an" are employed to describe elements and components of the embodiments herein. This is done merely for convenience and to give a general sense of the description. This description should be read to include one or at least one and the singular also includes the plural unless it is obvious that it is meant otherwise.

Still further, the figures depict preferred embodiments of a map editor system for purposes of illustration only. One skilled in the art will readily recognize from the following discussion that alternative embodiments of the structures and methods illustrated herein may be employed without departing from the principles described herein Upon reading this disclosure, those of skill in the art will appreciate still additional alternative structural and functional designs for a system and a process for identifying terminal road segments through the disclosed principles herein. Thus, while particular embodiments and applications have been illustrated and described, it is to be understood that the disclosed embodiments are not limited to the precise construction and components disclosed herein. Various modifications, changes and variations, which will be apparent to those skilled in the art, may be made in the arrangement, operation and details of the method and apparatus disclosed herein without departing from the spirit and scope defined in the appended claims.

The present disclosure provides a system comprising: a processor; a memory device coupled to the processor, and machine readable instructions stored on the memory device. In exemplary embodiments, the machine readable instructions that, when executed by the processor, cause the processor to (i) receive a plurality of data values, each data value is a measured expression level of a different gene in a sample obtained from a niche at the implantation site of a synthetic scaffold in a test subject;

(ii) process the plurality of data values though (a) a decomposition algorithm to obtain a single score for gene expression for the test subject, (b) a machine learning algorithm to obtain a score of prediction of disease state for the test subject, or (c) a combination of (a) and (b) to obtain a combined score for the test subject;

(iii) plot the single score for gene expression for the test subject, the score of prediction of disease state for the test subject, or the combined score for the test subject on a graphical or numerical output, wherein the graphical or numerical output comprises an average single score for gene expression for a control, an average score of prediction of disease state for a control, or an average combined score for a control.

In exemplary aspects, the control is a population of subjects known to not have an AID. In exemplary aspects, the control is a population of subjects known to have a pre-symptomatic stage of an AID. In exemplary aspects, the control is a population of subjects known to have a symptomatic stage of an AID. In exemplary aspects, the graphical or numerical output comprises the average score (single score for gene expression, score of prediction of disease state, or combined score) for multiple controls. In exemplary aspects, the graphical or numerical output comprises the average score (single score for gene expression, score of prediction of disease state, or combined score) for subjects known to have an AID, the average score for subjects known to not have an AID, and the average score for subjects known to have an AID.

In alternative or additional aspects, the system of the invention comprises machine readable instructions that, when executed by the processor, cause the processor to:

(i) receive a plurality of data values, each data value is a measured expression level of a different RNA of a sample obtained from a niche at the implantation site of a synthetic scaffold in a test subject;

(ii) process the plurality of data values though (a) a decomposition algorithm to obtain a single score for RNA expression for the test subject, (b) a machine learning algorithm to obtain a score of prediction of disease state for the test subject, or (c) a combination of (a) and (b) to obtain a combined score for the test subject;

(iii) plot the single score for RNA expression for the test subject, the score of prediction of disease state for the test subject, or the combined score for the test subject on a graphical or numerical output, wherein the graphical or numerical output comprises an average single score for RNA expression for a control, an average score of prediction of disease state for a control, or an average combined score for a control.

In exemplary aspects, the control is a population of subjects known to not have an AID. In exemplary aspects, the control is a population of subjects known to have a pre-symptomatic stage of an AID. In exemplary aspects, the control is a population of subjects known to have a symptomatic stage of an AID. In exemplary aspects, the graphical or numerical output comprises the average score (single score for gene expression, score of prediction of disease state, or combined score) for multiple controls. In exemplary aspects, the graphical or numerical output comprises the average score (single score for gene expression, score of prediction of disease state, or combined score) for subjects known to have an AID, the average score for subjects known to not have an AID, and the average score for subjects known to have an AID.

In yet further alternative or additional aspects, the system of the invention comprises machine readable instructions that, when executed by the processor, cause the processor to:

(i) receive a plurality of data values, each data value is a measured expression level of a different protein of a sample obtained from a niche at the implantation site of a synthetic scaffold in a test subject;

(ii) process the plurality of data values though (a) a decomposition algorithm to obtain a single score for protein expression for the test subject, (b) a machine learning algorithm to obtain a score of prediction of disease state for the test subject, or (c) a combination of (a) and (b) to obtain a combined score for the test subject;

(iii) plot the single score for protein expression for the test subject, the score of prediction of disease state for the test subject, or the combined score for the test subject on a graphical or numerical output, wherein the graphical or numerical output comprises an average single score for protein expression for a control, an average score of prediction of disease state for a control, or an average combined score for a control.

In exemplary aspects, the control is a population of subjects known to not have an AID. In exemplary aspects, the control is a population of subjects known to have a pre-symptomatic stage of an AID. In exemplary aspects, the control is a population of subjects known to have a symptomatic stage of an AID. In exemplary aspects, the graphical or numerical output comprises the average score (single score for gene expression, score of prediction of disease state, or combined score) for multiple controls. In exemplary aspects, the graphical or numerical output comprises the average score (single score for gene expression, score of prediction of disease state, or combined score) for subjects known to have an AID, the average score for subjects known to not have an AID, and the average score for subjects known to have an AID.

Also provided herein are computer-readable storage media having stored thereon machine-readable instructions executable by a processor. In exemplary embodiments, the instructions comprise:

(i) instructions for receiving a plurality of data values, each data value is a measured expression level of a different gene of a sample obtained from a niche at the implantation site of a synthetic scaffold in a test subject (ii) instructions for processing the plurality of data values though (a) a decomposition algorithm to obtain a single score for gene expression for the test subject, (b) a machine learning algorithm to obtain a score of prediction of disease state for the test subject, or (c) a combination of (a) and (b) to obtain a combined score for the test subject;

(iii) instructions for plotting the single score for gene expression for the test subject, the score of prediction of disease state for the test subject, or the combined score for the test subject on a graphical or numerical output, wherein the graphical or numerical output comprises an average single score for gene expression for a control, an average score of prediction of disease state for a control, or an average combined score for a control.

In alternative or additional embodiments, the instructions comprise:

(i) instructions for receiving a plurality of data values, each data value is a measured expression level of a different RNA of a sample obtained from a niche at the implantation site of a synthetic scaffold in a test subject (ii) instructions for processing the plurality of data values though (a) a decomposition algorithm to obtain a single score for RNA expression for the test subject, (b) a machine learning algorithm to obtain a score of prediction of disease state for the test subject, or (c) a combination of (a) and (b) to obtain a combined score for the test subject;

(iii) instructions for plotting the single score for RNA expression for the test subject, the score of prediction of disease state for the test subject, or the combined score for the test subject on a graphical or numerical output, wherein the graphical or numerical output comprises an average single score for RNA expression for a control, an average score of prediction of disease state for a control, or an average combined score for a control.

In yet further alternative or additional embodiments, the instructions comprise:

(i) instructions for receiving a plurality of data values, each data value is a measured expression level of a different protein of a sample obtained from a niche at the implantation site of a synthetic scaffold in a test subject (ii) instructions for processing the plurality of data values though (a) a decomposition algorithm to obtain a single score for protein expression for the test subject, (b) a machine learning algorithm to obtain a score of prediction of disease state for the test subject, or (c) a combination of (a) and (b) to obtain a combined score for the test subject;

(iii) instructions for plotting the single score for protein expression for the test subject, the score of prediction of disease state for the test subject, or the combined score for the test subject on a graphical or numerical output, wherein the graphical or numerical output comprises an average single score for protein expression for a control, an average score of prediction of disease state for a control, or an average combined score for a control.

The controls may be as those described above.

Further provided herein are methods implemented by a processor in a computer. In exemplary embodiments, the method comprises the steps of:

(i) receiving a plurality of data values, each data value is a measured expression level of a different gene of a sample obtained from a niche at the implantation site of a synthetic scaffold in a test subject;

(ii) processing the plurality of data values though (a) a decomposition algorithm to obtain a single score for gene expression for the test subject, (b) a machine learning algorithm to obtain a score of prediction of disease state for the test subject, or (c) a combination of (a) and (b) to obtain a combined score for the test subject;

(iii) plotting the single score for gene expression for the test subject, the score of prediction of disease state for the test subject, or the combined score for the test subject on a graphical or numerical output, wherein the graphical or numerical output comprises an average single score for gene expression for a control, an average score of prediction of disease state for a control, or an average combined score for a control.

In alternative or exemplary embodiments, the method comprises the steps of:

(i) receiving a plurality of data values, each data value is a measured expression level of a different RNA of a sample obtained from a niche at the implantation site of a synthetic scaffold in a test subject;

(ii) processing the plurality of data values though (a) a decomposition algorithm to obtain a single score for RNA expression for the test subject, (b) a machine learning algorithm to obtain a score of prediction of disease state for the test subject, or (c) a combination of (a) and (b) to obtain a combined score for the test subject;

(iii) plotting the single score for RNA expression for the test subject, the score of prediction of disease state for the test subject, or the combined score for the test subject on a graphical or numerical output, wherein the graphical or numerical output comprises an average single score for RNA expression for a control, an average score of prediction of disease state for a control, or an average combined score for a control.

In yet further alternative or exemplary aspects, the method comprises the steps of:

(i) receiving a plurality of data values, each data value is a measured expression level of a different protein of a sample obtained from a niche at the implantation site of a synthetic scaffold in a test subject;

(ii) processing the plurality of data values though (a) a decomposition algorithm to obtain a single score for protein expression for the test subject, (b) a machine learning algorithm to obtain a score of prediction of disease state for the test subject, or (c) a combination of (a) and (b) to obtain a combined score for the test subject;

(iii) plotting the single score for protein expression for the test subject, the score of prediction of disease state for the test subject, or the combined score for the test subject on a graphical or numerical output, wherein the graphical or numerical output comprises an average single score for protein expression for a control, an average score of prediction of disease state for a control, or an average combined score for a control.

The controls may be as those described above.

The following examples are given merely to illustrate the present invention and not in any way to limit its scope.

EXAMPLES

Example 1

This example describes an exemplary method carried out to harness transcriptome data from autoimmune niches and to identify a predictive signature.

An illustration of the experimental procedure carried out in multiple studies is shown in FIG. 1A. At Day −14, a polymer scaffold comprising polycaprolactone (PCL) was implanted into the subcutaneous space of mice. In some studies, as described below, the procedure was carried out in experimental autoimmune encephalomyelitis (EAE) mice having a Swiss Jim Lambert (SJL) background. The EAE mouse model is a well-known animal model for relapsing-remitting multiple sclerosis (RR-MS). The foreign body response (FBR) to the implanted scaffolds was allowed to normalize in vivo for two weeks. In one study, as described below, disease was induced by immunization of mice with proteolipid protein peptide 139-151 (PLP) in complete Freund's adjuvant (CFA). The control group of mice in this study were immunized with an ovalbumin peptide (termed OVA). In another study, as described below, disease was induced with adoptively transferred autoreactive T-cells which recognize PLP. The control group of mice in this study was given autoreactive T-cells which recognize the OVA peptide. The mice were evaluated for symptoms of the disease including body condition and given a clinical score reflective of their coordination and level of paralysis which results from autoimmune-induced damage to neural tissue. As shown by the graph in FIG. 1B, disease symptoms began to show about 7 days after immunization of mice. As shown in FIG. 1B, on Day 7 (represented by the dot), mice were pre-symptomatic (e.g., did not exhibit any signs or symptoms of disease) and thus the clinical score was zero. On Day 9 (represented by the dot), mice exhibited symptoms and thus the clinical score on this day was about 3.5. In one study, as described below, mice were evaluated on Day 13, instead of Day 9.

On the same day the mice were clinically scored, scaffolds were excised. Cells from the polymer scaffold were homogenized with a mechanical dispersing instrument in Trizol reagent. RNA isolation was carried out via centrifugation filter kits that include a DNA enzymatic degradation. Quality and quantity of the RNA was assessed via a Bioanalyzer 2100 and Nanodrop 2000c, respectively. RNA was synthesized into cDNA via reverse transcription, following suggested preparation protocols for high-throughput RT-qPCR using a TaqMan® OpenArray® panel. The high-throughput RT-qPCR was carried out using a TaqMan® OpenArray® Mouse Inflammation Panel on a QuantStudio™ 12K Flex. The OpenArray® panel analyzes the expression of 648 genes that are associated with immunological pathways. Instrument parameters and quality control was managed by the University of Michigan DNA Sequencing Core. Additionally, single tube RT-qPCR was carried out on a subset of genes (determined from the OpenArray results) using Taqman probes to validate the results found using the high-throughput results as well as expand our tests. Gene expressions were normalized to a combination of 5 different housekeeping genes as determined by a house gene stability analysis of the 16 housekeeping genes included in the OpenArray® panel.

As shown in FIG. 1A, normalized gene expression data, obtained as described above, were processed through a computational model which employed a combination of machine learning and dimensionality reduction approaches—singular value decomposition (SVD) and RANDOM FOREST™ (RF) ensemble (i.e., bootstrap aggregated (bagged) decision tree ensemble) classification—to identify genes that had differential expression of a high magnitude between healthy and diseased animals that was statistically significant and predictive of disease category (sick or healthy) by the regularized regression method, elastic net and to assign a score to each animal indicative of disease state. SVD was an unsupervised algorithm and RF was a trained algorithm. In this manner, a multivariate gene expression signature (GES) capable of determining whether a mouse is diseased or healthy was developed. These identified genes comprised the gene expression signature (GES) that could be used for various biological insights and patient monitoring. A variety of graphical outputs, including frequency vs. fold change plots, volcano plots, heatmaps, were generated.

Example 2

This example demonstrates the harnessing of data from unmodified synthetic scaffolds to monitor disease progression in experimental autoimmune encephalomyelitis (EAE), the animal model for relapsing-remitting multiple sclerosis (RR-MS).

The procedure described in Example 1 was carried out with EAE mice. To induce disease in one group of EAE mice, a PLP peptide in complete Freund's adjuvant was injected into the mice. Healthy mice were used as a control. Scaffolds were excised at two time points: 7 days after injection (representing a pre-symptomatic disease state) and 13 days after injection (representing peak disease). Cells from the scaffolds were processed and RNA was isolated as described in Example 1. RNA was used to synthesize cDNA via reverse transcription, following suggested preparation protocols for high-throughput qRT-PCR using a TaqMan® OpenArray® panel. Gene expression data were processed through the computational model employing the SVD and RF algorithms and scores were assigned and plotted. For the RF machine learning the training cohorts were assigned as a binary Healthy Control (HC) or as Diseased. The stratification based on disease state is representative of the differences in gene expression and not predetermined during the RF model training. Thus, for computational purposes data points at Days 7 and 13 are treated as a single cohort but are identified by color on all plots.

Figure 2B:
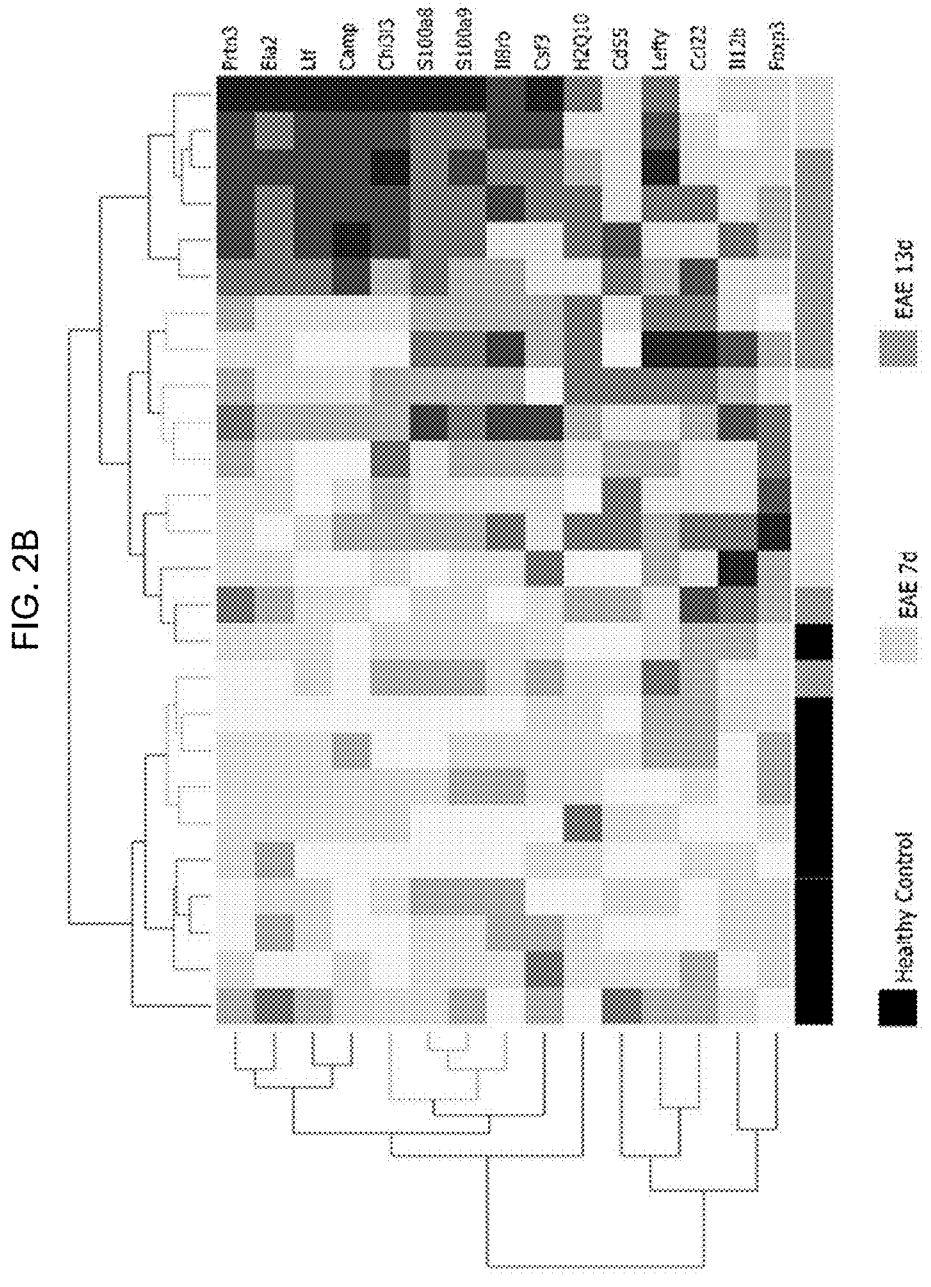
FIG. 2B is a heatmap of gene expression for the 15 genes that reliably change in scaffolds in disease.
Figure 2C:
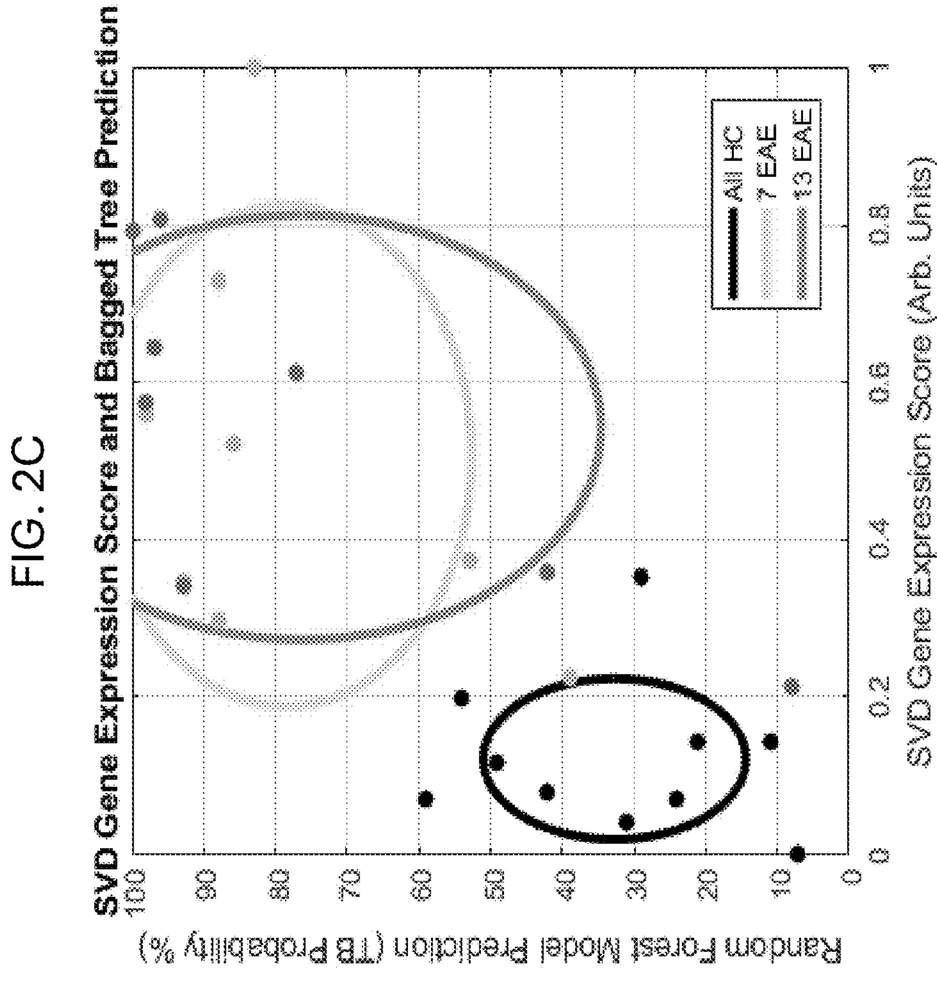
FIG. 2C is a graphical output of computational analysis of gene expression signature for EAE.

FIGS. 2*a*-2*c* depict a series of graphs demonstrating that EAE induced changes in the transcriptome within the niche created at the scaffold, relative to the control. A volcano plot (a compilation of log-transform fold changes (x-axis) and log-transformed p-values (y-axis)) was generated to compare diseased cohorts and matched healthy controls. The volcano plot is shown in FIG. 2A. Sixty-two genes exhibited a significant change in expression between healthy and diseased animals. In FIG. 2A, above the black line is a p value<0.05 and outside the lines is a fold change>±2.

Elastic net regularization enabled selection of 15 genes that reliably change in scaffolds in disease: Prtn3, Ela2, Ltf, Camp, Chi3l3, S100a8, S100a9, Il8rb, Csf3, H2Q10, Cd55, Lefty, Ccl22, Il12b, and Foxp3. Some of the genes have known roles in EAE; for example, Foxp3 expression is reduced in the scaffold in disease induction corresponding to decreased Treg activity at the scaffolds. Unsupervised hierarchal clustering was used to create a heatmap of gene expression from inflammatory niches of mice (at the location of implanted scaffolds) that had EAE for 7 or 13 days in addition to time matched healthy controls. FIG. 2B is the heatmap of gene expression from the 15 genes.

FIG. 2C is a graphical output of computational analysis of gene expression signature for EAE. RANDOM FOREST™ score was plotted versus SVD. Ovals represent 99.9% CO for indicated time points and individual points represent scores assigned to scaffolds from individual animals. As shown in this figure, the healthy clustered together and the diseased clustered separately demonstrating that a combination of transcriptomics, traditional qPCR, and computational analysis of engineered inflammatory niches enables the creation of a predictive, diagnostic gene expression signature via a simple subcutaneous biopsy.

This example demonstrated that the multivariate disease gene expression signature paired with computational models accurately striates diseased populations.

Example 3

This example demonstrates the harnessing of data from scaffolds implanted in SJL mice that received adoptively transferred autoreactive T cells.

The procedure described in Example 1 was carried out with SJL mice and disease was induced using adoptively transferred autoreactive T cells. The procedure carried out in this study is illustrated in FIG. 3. To induce disease in one group of SJL mice, adoptively transferred autoreactive T cells (reactive to PLP peptide) were injected into the mice. To a control group of mice, adoptively transferred autoreactive T cells (reactive to an OVA peptide) were injected.

Scaffolds were excised at two time points: 7 days after injection (representing a pre-sympotmatic disease state) and 9 days after injection (representing peak disease). The disease course or the rate of increase of the clinical score increases when the disease is induced by autoreactive T cells, compared to disease induction via peptide injection. Cells from the scaffolds were processed and RNA was isolated as described in Example 1. RNA was used to synthesize cDNA via reverse transcription, following suggested preparation protocols for high-throughput qRT-PCR using a TaqMan® OpenArray® panel. Gene expression data were processed through the computational model employing the SVD and RF algorithms and scores were assigned and plotted. As detailed in Example 2, data from both Day 7 and Day 9 time points were computationally characterized as either control or Diseased. Thus, in the same manner as Example 2 there is no predetermined stratification of samples based on time.

FIG. 4A is a graph depicting the frequency of fold change for all genes analyzed as a function of fold change (log 2 fold change). Data shows the frequency of change for the transcriptome of the scaffold on Day 7 and the frequency of change for the transcriptome of the scaffold on Day 9. As shown in FIG. 4B, the transcriptome changes occur both pre-symptomatically (at Day 7) and during clinical onset (at Day 9). Over 180 genes were differentially expressed ($p<0.05$) with many having a large fold change (FC, data displayed as log base 2).

Figure 5:
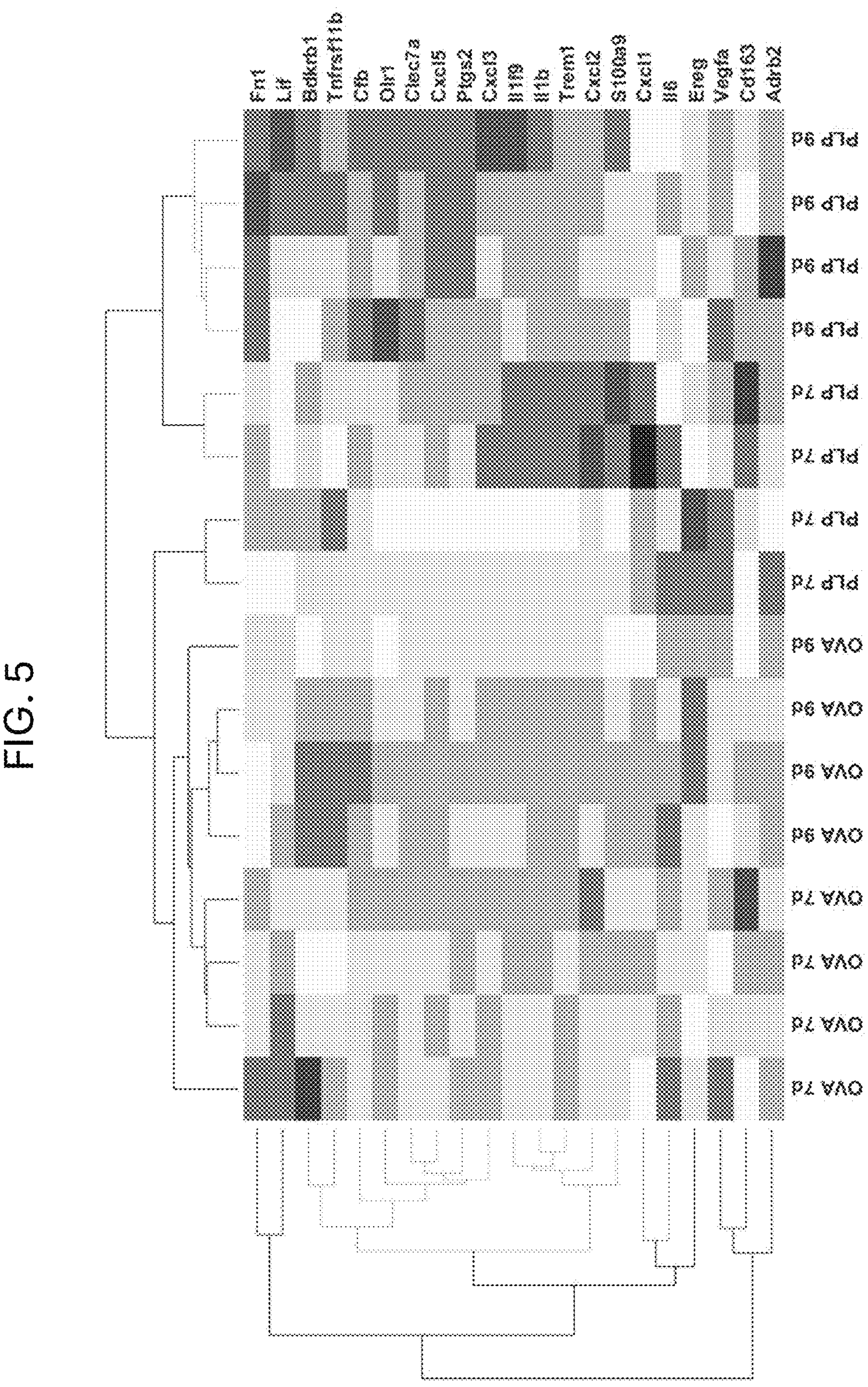
FIG. 5 is a heatmap of gene expression from the 21 genes and demonstrates that hierarchical clustering separates diseased and control mice.

Elastic net regularization enabled selection of 21 genes that reliably change in scaffolds in disease: Fn1, Lif, Bdkrb1, Tnfrsf11b, Cfb, Olr1, Clec7a, Cxcl5, Ptgs2, Cxcl3, Il1f9, Il1b, Trm1, Cxcl2, S100a9, Cxcl1, Il6, Ereg, Vegfa, Cd163, Adrb2. Unsupervised hierarchal clustering was used to create a heatmap of gene expression from inflammatory niches of mice (at the location of implanted scaffolds) that had EAE for 7 or 9 days in addition to time matched healthy controls. FIG. 5 is the heatmap of gene expression from the 21 genes and demonstrates that hierchical clustering separates diseased and control mice.

Figures 6A, 6B:
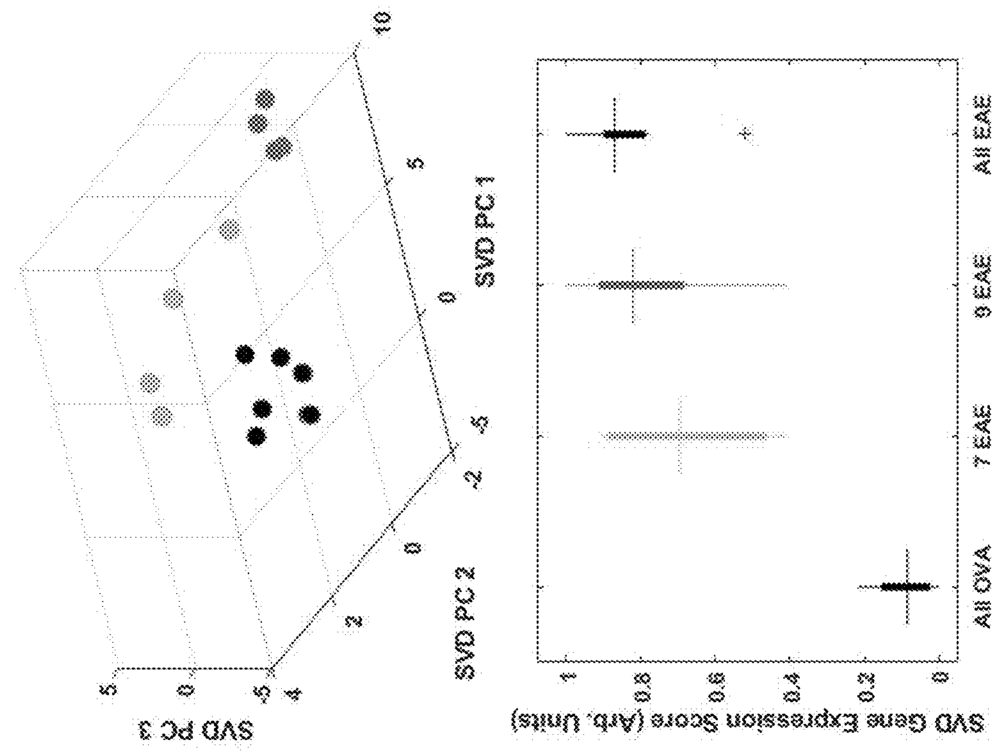
FIG. 6A is a 3-dimensional plot of the principle components of the SVD matrix.
FIG. 6B is a graph of the SVD gene expression score (calculated by determining the distance each point is from the centroid of the control cloud) for control or diseased states (pre-symptomatic "7 EAE" and symptomatic "9 EAE".
Figure 7:
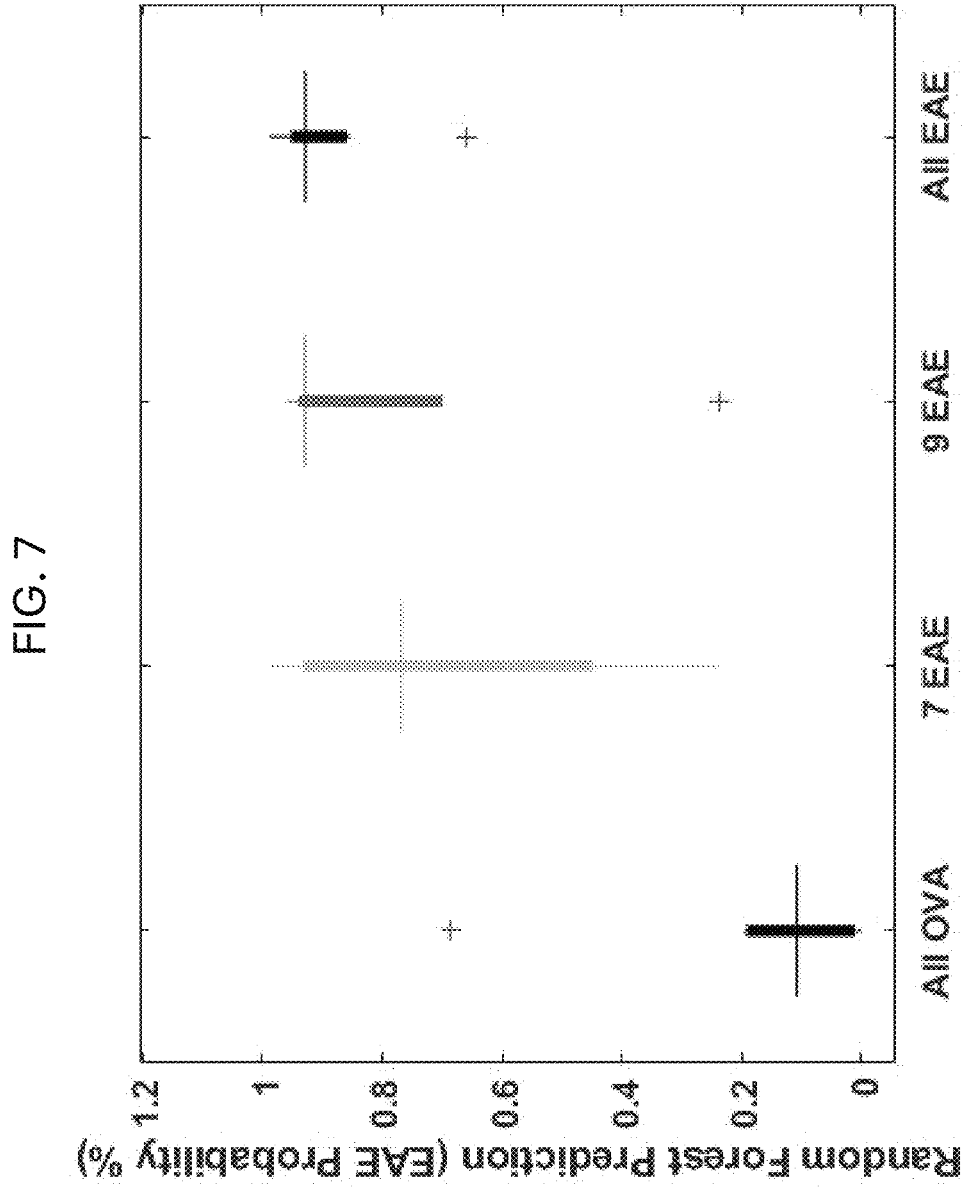
FIG. 7 is a graph of the RF prediction score for control or diseased states (pre-symptomatic "7 EAE" and symptomatic "9 EAE".

SVD was used to help create a multivariate signatures. SVD is an unbiased dimensionality reduction technique. FIG. 6A is a 3-dimensional plot of the principle components of the SVD matrix and FIG. 6B is a graph of the SVD gene expression score (calculated by determining the distance each point is from the centroid of the control cloud) for control or diseased states (pre-symptomatic "7 EAE" and symptomatic "9 EAE". RANDOM FOREST™ (RF), also known as Bagged Decision Tree, was used to help create multivariate signature. RF is a biased machine learning algorithm. It weights each gene to try to separate healthy and diseased as correctly as possible. FIG. 7 is a graph of the RF prediction score for control or diseased states (pre-symptomatic "7 EAE" and symptomatic "9 EAE". A multivariate signature plot of the RF model prediction vs SVD was generated (FIG. 8). As shown in FIG. 8, the plot very clearly separates EAE mice from OVA controls.

A single numeric Gene Expression Score was created by calculating the distance each point was from the centroid of the ellipses in the Multivariate plots. These scores were plotted vs clinical score the day after the biopsy was taken. FIG. 9 is a graph of the single numeric Score plotted as a function of clinical score the day after biopsy. $R^2>0.9$ This example demonstrated the ability to monitor EAE mice using subcutaneously implanted scaffolds in an adoptive transfer model of EAE, a model that is more representative of the human physiology due to the lack of the presence of complete Freund's adjuvant. It demonstrated that the model is predictive of disease onset and that the gene scores correlate with severity of disease.

Example 4

This example describes the ability of the engineered niche to monitor an antigen-specific treatment and the development of a signature predictive or reflective of treatment. The expanded multivariate GES can be created as a prognostic for treatment monitoring using engineered inflammatory niches.

Despite efforts to develop treatments for multiple sclerosis, existing drugs tend to have broad immunosuppressive activity which can result in severe complications or opportunistic infections. Additionally, some drugs are indicated for use only after failure of a first-line treatment to alter clinical disease course. If a prognostic tool provided insight into treatment responsiveness, it could lead to better patient outcomes by allowing immunosuppressive drugs to be implemented only during periods of high relapse likelihood, and prevention of ongoing damage during the iterative process of finding the appropriate drug.

Figure 10A:
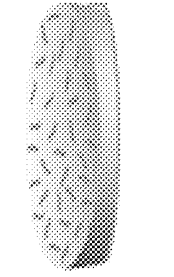
FIG. 10A is an illustration of nanoparticles formulated with antigen-polymer bioconjugates and components thereof.
Figure 10B:
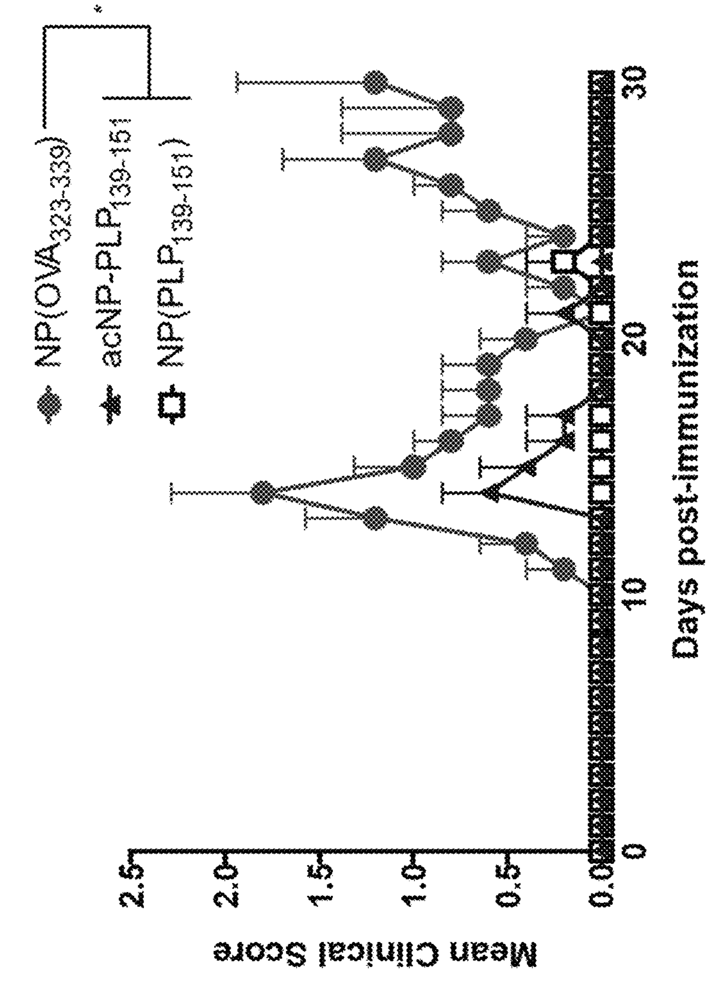
FIG. 10B is a graph of clinical score as a function of time for subjects treated with a control particle loaded with model antigen from the ovalbumin protein, encapsulated antigen, or antigen polymer bioconjugates.

Novel antigen specific treatments for autoimmune diseases have been investigated by developing nanoparticle-based platforms capable of harnessing innate pathways of peripheral tolerance to induce a tolerogenic phenotype in animals with EAE. Nanoparticles formulated with antigen-polymer bioconjugates have been developed that give us precise control over antigen loading in a modular platform and provide antigen-specific nanotherapeutics for treating EAE. FIG. 10A. Modularity and precise control of loading by defined mixing is enabled by conjugating antigen to polymer and mixing this with unmodified polymer. As shown in FIG. 10B, when administered prophylactically, these therapies specifically reduce symptoms of EAE (*$p<0.05$). The trace of FIG. 10B is a control particle loaded with model antigen from the ovalbumin protein, black trace is encapsulated antigen, and trace is antigen polymer bioconjugates. FIG. 10B thus demonstrates that antigen-specific nanoparticles ameliorate disease when administered prophylactically, but non-specific particles do not. (a) (Casey et al., Bioconjug. Chem. 29(2018) 813-823. doi: 10.1021/acs.bioconjchem.b00624). These and similar treatments have demonstrated the successfully mitigation of EAE when administered prophylactically and as a therapy [Hunter et al., ACS Nano 8 (2014) 214-2160. doi:10.1021/nm405033r.; Casey et al., Bioconjug. Chem. 29(2018) 813-823. doi:10.1021/acs.bioconjchem.b00624; Getts et al., Nat. Biotechnol. 30(2012) 1217-1224. doi:10.1038/nbt.2434; and Prasad et al., J. Autoimmun. (2017) 1-13. doi:10.1016/j.jaut.2017.12.010].

Figure 11:
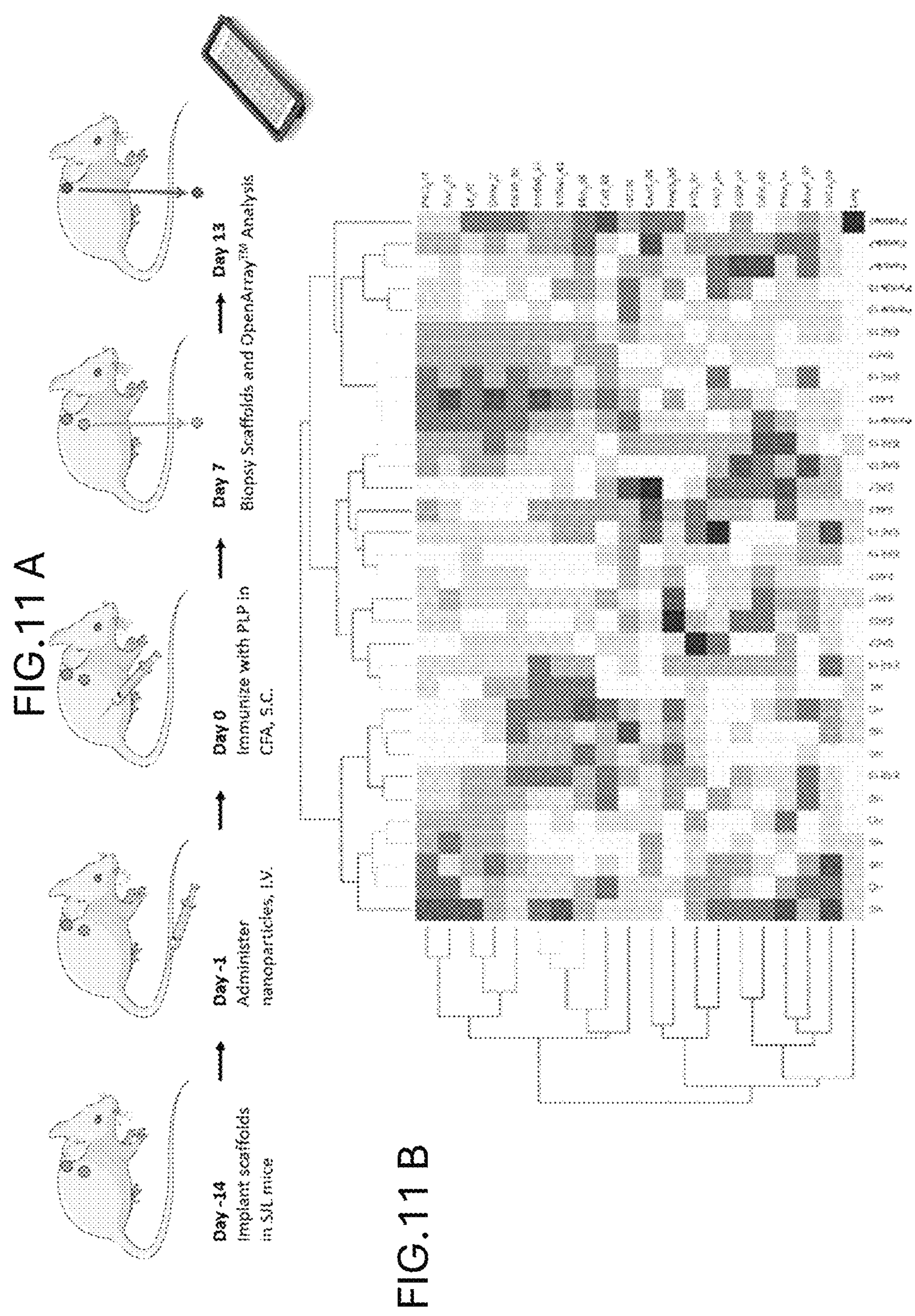
FIG. 11A is a schematic of the events in the study wherein a prophylactic dose of nanoparticles are administered to mice.
FIG. 11B is a heatmap of gene expression from the 20 genes.

A schematic of the events in this study are shown in FIG. 11A. Naked scaffolds were first implanted into SJL mice on Day −14. The FBR was allowed to normalize for two weeks. At Day −1, a 2-mg prophylactic dose of nanoparticles formulated with antigen-polymer bioconjugates (acNP-PLP) was administered to the mice. On Day 0, the mice were immunized with proteolipid protein peptide 139-151 (PLP) in complete Freund's adjuvant (CFA). On Day 7 or 13 post-immunization, scaffolds were excised and flash frozen for RNA isolation. After RNA isolation and analysis of gene expression by Open Array™ (as described above), unsupervised hierarchal clustering was used to create a heatmap of gene expression from niches of mice (at the location of implanted scaffolds) that had EAE for 7 or 13 days with or without nanoparticles in addition to time matched healthy controls. FIG. 11B is the heatmap of gene expression from the 20 genes (15 genes described in Example 2 and 5 genes that were differentially expressed between untreated EAE mice and particle treated). The 20 genes were Prtn3, Ela2, Ltf, Camp, Chi3l3, S100a8, S100a9, Il8rb, Csf3, H2Q10, Foxp3, Il12b, Cd55, Ccl22, Lefty, Cxcr3, Klrg1, Ccl24, Procr, and Masp.

Figure 12:
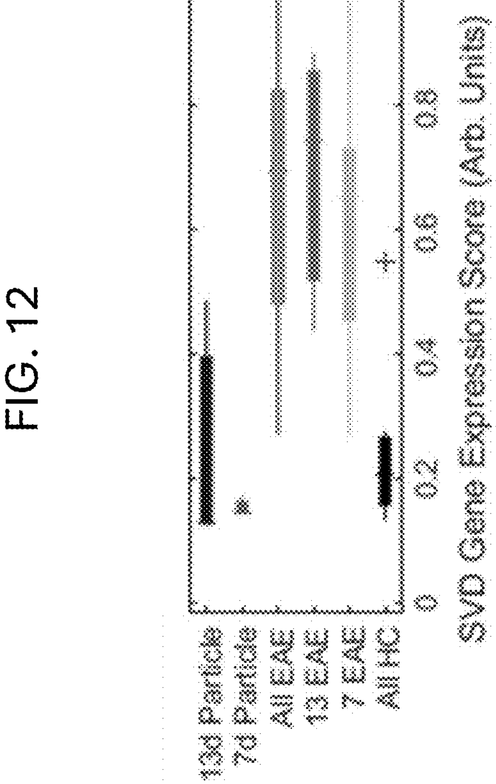
FIG. 12 is a 1-d simplification of a bar chart of the SVD expression score shown to highlight differences and range of the data.

The computational model combining SVD and RF algorithms was applied to analyze the panel of 20 genes to create an expanded multivariate signature capable of treatment monitoring. FIGS. 12 and 13 represent the output of computational analysis of gene expression signature for treatment monitoring in EAE. FIG. 12 is a 1-d simplification of a bar chart of the SVD expression score shown to highlight differences and range of the data. FIG. 13 is a graph of the RANDOM FOREST™ score plotted versus SVD. Ovals represent 99.9% CI for indicated time points and individual points represent scores assigned to scaffolds from individual animals. As shown in FIG. 13, the GES and data it outputs separated diseased and healthy mice very well. Also, the particle-treated mice separated as a distinct population from diseased and from healthy, suggesting that multivariate gene expression signatures derived from engineered inflammatory niches can extend beyond diagnostic information to a prognostic tool capable of treatment monitoring.

This example demonstrated that this technology can be used for patient monitoring and as a companion diagnostic.

Example 5

This example describes a GES for incorporating exogenous factors into scaffolds to enrich populations of autoreactive cells at the scaffolds to amplify signals of disease or enable personalized medicine approaches.

The study begins by creating scaffolds with various amounts of antigen. Peptide polymer bioconjugates created from conjugating antigen to acid terminated PCL, PLG, or any other polymer are used in a similar manner to that used to fabricate our PLG nanoparticles [Kuo et al., Mol. Ther. 25 (2017) 1676-1685. doi:10.1016/j.ymthe.2017.03.032; Pearson et al., Mol. Ther. 25 (2017) 1655-1664. doi:10.1016/j.ymthe.2017.04.015]. The advantage of this method over simple adsorption is it allows for precise control of antigen loading simply by doping in various amount of antigen conjugated PCL, extends delivery times over simple encapsulation, and its modularity allows facile incorporation of other polymer conjugates for future studies. In studies creating nanoparticles a range of antigen coupled polymer incorporation from 0.2%-15% antigen conjugated polymer by mass achieved physiological responses.

The EAE antigen $PLP_{139-151}$ is conjugated to scaffolds at the pre-determined optimal antigen loading dose. Each mouse of the study receives 6 scaffolds (two of each type: naked scaffolds, $OVA_{323-339}$ conjugated scaffolds, and $PLP_{139-151}$ antigen-loaded scaffolds). Scaffolds are excised before disease onset (at day 7 post-induction), and at peak disease (day 9-13). Gene expression of cells from the excised scaffolds is evaluated by a TaqMan® OpenArray® Panel of 648 genes focused on mouse inflammatory pathways at 7 and 13 days post-immunization, as described in Example 1. A computational model employing a combination of machine learning and dimensionality reduction approaches—singular value decomposition (SVD) and RANDOM FOREST™ (RF) ensemble classification—is applied to develop a multivariate signature capable of determining whether a mouse is diseased or healthy, as described in the above Examples.

These data suggest that the GES is useful for more than treatment monitoring, but also for diagnosis and general patient monitoring.

Example 6

This example describes a study that identifies the design of an implantable scaffold, determines the specificity of the niche and the changes in population with the inclusion of antigen, and quantitatively evaluates the enrichment of antigen-specific T cells.

Scaffolds are loaded with controlled quantities of the antigen by direct conjugation of antigens ($PLP_{139-151}$, $OVA_{323-339}$) to carboxylic acid terminated PCL via carbodiimide crosslinking, a routine procedure in our laboratory (Hunter et al., *ACS Nano* 8, 2148-2160 (2014); Kuo et al., *Mol. Ther.* 25, 1676-1685 (2017)). Note that PLP is the dominant antigen for the SJL mouse model of EAE, and the OVA peptide can serve as a control in the SJL mouse. Additionally, the OT-II mouse are used to investigate scaffold recruitment since the overwhelming majority of CD4 T-cells are reactive to $OVA_{323-339}$, and PLP will serve as a control antigen. Peptide conjugation to the polymer is confirmed via $^{1}H$-NMR analysis and HPLC. Next, scaffolds are pressed with 4 concentrations of the peptide antigen conjugated polymer: 1%, 10%, 25%, and 50% (w/w) with unconjugated PCL, with loading confirmed by protein analysis. A control condition involves adsorption of antigen to the scaffold. Release studies are performed with measurement by ELISA to determine retention of peptide at the scaffold.

Scaffolds ($PLP_{139-151}$, $OVA_{323-339}$, and without peptide modification) are implanted into the SJL and OT-II mouse models. Scaffolds with varying peptide loading are implanted subcutaneously. For the OT-II model, scaffolds are implanted for 21 days (the shortest implantation timepoint in the EAE experiments). After 21 days, scaffolds are explanted and immune cells are isolated as previously described. For the EAE model, three types of scaffolds are implanted into the subcutaneous space of two cohorts of SJL mice: naked PCL scaffolds (negative control), $OVA_{323-339}$ loaded (as a non-specific antigen loaded control), and $PLP_{139-151}$ loaded. Two weeks after scaffold implantation, the first cohort of SJL mice receives adoptive transfers of $PLP_{139-151}$ reactive cells to induce EAE and the second cohort will receive adoptive transfers of $OVA_{323-339}$ reactive cells (negative control). Scaffolds are excised before disease onset (at day 7 post-induction), and at peak disease (day 13). Additionally, diseases scores are closely monitored to determine any influence antigen releasing foreign bodies may have on the disease course.

On scaffold isolation days, immune cells are isolated and analyzed via flow cytometry to determine relative populations and on the terminal day spleens, spinal cords, and peripheral blood are also analyzed. Flow cytometry is used to identify the relative percentages of immune cells including: macrophages, monocytes, DCs, NK cells, CD4+ T cells, CD8+ Tcells, Tregs, and B cells. Previous studies have indicated n=10-12 per condition is sufficient to identify dynamic trends in the distribution of cells. Data are analyzed via FlowJo (Treestar, Inc.) and gated as previously described. Additionally, spleens, peripheral blood, and draining lymph nodes of these mice are harvested for comparison. The scaffold with the maximal recruitment of T cells is determined and the antigen loading is identified as the preferred fabrication method for further experiments.

During flow cytometry, CD4+ and CD8+ cells are collected by FACS from each sample for further analysis by ELISPOT assays for IL-2 in 96-well plates. Each well contains either CD4+ or CD8+ T cells isolated from the scaffold and organ FACS and splenocytes from naïve mice. For each sample three wells for each cell type: no antigen, $PLP_{139-151}$ in cell media, and $OVA_{323-339}$ are run in cell media for 24 hours before developing. Spots are counted per well to determine the number of antigen reactive T cells at each scaffold and in the isolated organ samples.

Example 7

This example demonstrates the construction of a molecular signature for adaptive alterations in autoimmune disease.

Scaffolds (both antigen-loaded and naked) are implanted into the dorsal subcutaneous space of mice two weeks prior to EAE induction (n=5 per group). Cohorts of scaffold implanted mice, but without disease induction agents, serve as time-matched healthy controls. Adoptive transfer of T cells from mice immunized with either $PLP_{139-151}$ (diseased) or $OVA_{323-339}$ (healthy control) are employed to initiate diseases or serve as control respectively. Scaffolds are biopsied post-EAE induction to correspond with disease stages as follows: pre-symptomatic (day 7), peak disease (day 13), remission (day 20), and relapse (time points variable).

Molecularly define niche via gene expression analysis (i.e., phenotype): The gene expression for scaffolds implanted to mice with EAE are characterized through RNAseq analysis at multiple times (day 7, 13, 20, 42). Preliminary data are collected with mice immunized for either 7 (pre-symptomatic) or 13 days (peak disease). A preliminary signature was created using OpenArray data that is able to separate diseased and healthy mice (Examples 2 and 3). This initial signature correctly delineates mice with disease from those without disease. Importantly, changes are detected within the scaffold prior to an increase in clinical disease score. For RNAseq analysis, samples are collected and analyzed similarly to Examples 2 and 3. The transcripts identified as significantly changing within the scaffold will be used as a panel for analysis by qRT-PCR, which provides a cost-effective screening assay for the development of the signature in autoimmune disease. This experiment integrates the gene expression data from RNAseq, with quantification by qRT-PCR, into a signature that reflects disease status at any given point.

Multivariate analysis and signature development: A multivariate signature is generated from the RNAseq and PCR data, with the data analyzed as in Examples 2 and 3 using multiple machine learning and dimensionality reduction approaches including: singular value decomposition (SVD), RANDOM FOREST™ (RF) ensemble classification, and partial least squares discriminate analysis (PLSDA). To confirm the functional utility of the signature, scaffolds isolated at the remission and relapse time points are analyzed and a score developed to determine consistency with the clinical score. As validation, the signature of disease status developed from the synthetic scaffold is correlated with the signature and gene expression from other organs involved in EAE progression, namely CNS, lymph node, spleen, and peripheral blood, at each time point. Additionally, it is determined if peptide-loaded scaffolds outperform the naked scaffolds for their ability to predict disease. Subsequent studies use scaffolds that maximize the prediction of disease.

Example 8

This example demonstrates the construction of a molecular signature for monitoring therapeutic response in MS.

The goal of this study is to determine if the signature developed in Example 6 has utility in monitoring treatments for MS. Multiple treatments exist for MS (most of which were discovered in the EAE model) including broad immunosuppressive drugs such as prednisone, immunomodulatory approaches such as IFN-β, or more targeted approaches such as natalizumab (an anti-VLA-4 antibody). While these interventions can be effective, they are not equally effective in every patient and some patients receive multiple therapies (all the while experiencing multiple relapses) before they find a treatment that works for them. Additionally, our lab has extensive experience developing nanoparticle therapeutics for EAE which could be very useful in studying the effects of treatment on the molecular signature. Implantable scaffolds that are predictive of disease status are likely to reflect treatment effectiveness before incidence of relapse thus allowing a precision health approach to the treatment of multiple sclerosis.

Treatment Monitoring of Standard-of-Care Therapies and Emerging Nanoparticle-Based Tolerance The responsiveness of the scaffold microenvironment to treatment begins with three standard-of-care treatments: IFN-β, fingolimod, and an anti-VLA-4 antibody (non-humanized analogue of natalizumab: hereafter referred to simply as natalizumab). these treatments were selected because they comprise a spectrum of treatments in MS, with IFN-β being a broad immunomodulator, fingolimod being both an immunosuppressant because of its sequestration of lymphocytes but also an immunomodulator of macrophage phenotype, and natalizumab representing a class of drug that is used as a second-line treatment or in highly active cases. (Hutchinson, M., *Ther. Clin. Risk Manag.* 3, 259-268 (2007); McCormack et al., *Drugs* 73, 1463-1481 (2013)).

The study begins by implanting the top performing scaffolds from Example 5 into SJL mice and two weeks later performing adoptive transfers of T-cells reactive to $PLP_{139-151}$ (to induce EAE) or $OVA_{323-339}$ (control group). Four groups are created: IFN-β, fingolimod, natalizumab, and vehicle control. The drugs are administered via intraperitoneal injection every two days following onset of EAE symptoms (n=5 per group). It is expected that the vehicle control mice will experience relapse at approximately day 40 post adoptive transfer and that the drug treated mice will experience more mild relapses or none at all. When ⅔ of the vehicle control mice have experienced relapse, implants and CNS are harvested and analyzed via the signature. It is then determined if the signature is indicative of treatment efficacy in the mice and if the signature score correlates with disease score after treatment.

Nanoparticles have been developed for tolerance in EAE have been shown to ameliorate disease. Such particles have recently advanced into clinical trials for autoimmune disease (Kuo et al., Mol. Ther. 25:1676-1685 (2017); Mccarthy et al., Nanomedicine Nanotechnology, Biol. Med. 13:191-200 (2017); Hlavaty et al. Biomaterials 76:1-10 (2016); Luo et al. Immune Tolerance for Autoimmune Disease and Cell Transplantation. 181-208 (2016). doi:10.1146/annurev-bioeng-110315-020137; Casey et al., *Bioconjug. Chem.* acs.bioconjchem.7b00624 (2017). doi:10.1021/acs.bioconjchem.7b00624; Getts et al., *Nat. Biotechnol.* 30, 1217-1224 (2012)). The nanoparticles are administered to treat disease, and the signature is examined to characterize the normalization of the immune response. The cohort is divided into two groups, either an $OVA_{323-339}$ (control) particle treated or $PLP_{139-151}$ particle treated (n=5 per group). Scaffolds are implanted on day −14 and particles will be administered (IV) either on day −1 (prophylactic) or day 13 (treatment), with adoptive transfer to initiate disease performed on day 0. OVA control mice are expected to relapse while the PLP particle-treated mice will maintain low clinical scores. Upon relapse, implants and CNS are harvested and analyzed via the signature. It is determined if the signature is able to monitor the induction of tolerance by antigen-specific nanotherapeutics. Preliminary studies (described in Example 3) have identified a 20 gene signature using SVD using data obtained by the OpenArray system. SVD scores of particle-treated mice cluster with healthy mice, with a significantly greater SVD score for mice with disease. These studies support scaffolds for monitoring therapeutic response in EAE, and that particles normalize the immune signature.

Example 9

This example demonstrates the construction of a GES for diabetes.

In this study, Non-obese diabetic (NOD) mice are used to create a GES for diabetes. NOD mice are widely used as an animal model for type 1 diabetes because a large percentage of mice spontaneously develop disease. In NOD mice, diabetes develops as a result of insulitis, a leukocytic infiltrate of the pancreatic islets. The onset of diabetes is associated with a moderate glycosuria and a non-fasting hyperglycemia. In this study, NOD mice were implanted with 6 scaffolds, as described in Example 5. The blood glucose was tracked over time as scaffolds were periodically excised. Diabetic progression was defined by blood glucose (BG; mg/dL) as follows: (i) Healthy=BG<140; (ii) prediabetic=140<BG<200; and (iii) diabetic=BG>200. The scaffolds were excised from the animals as previously described and the cells were examined. RNA was isolated and analyzed via OpenArray™ analysis.

Figure 14A:
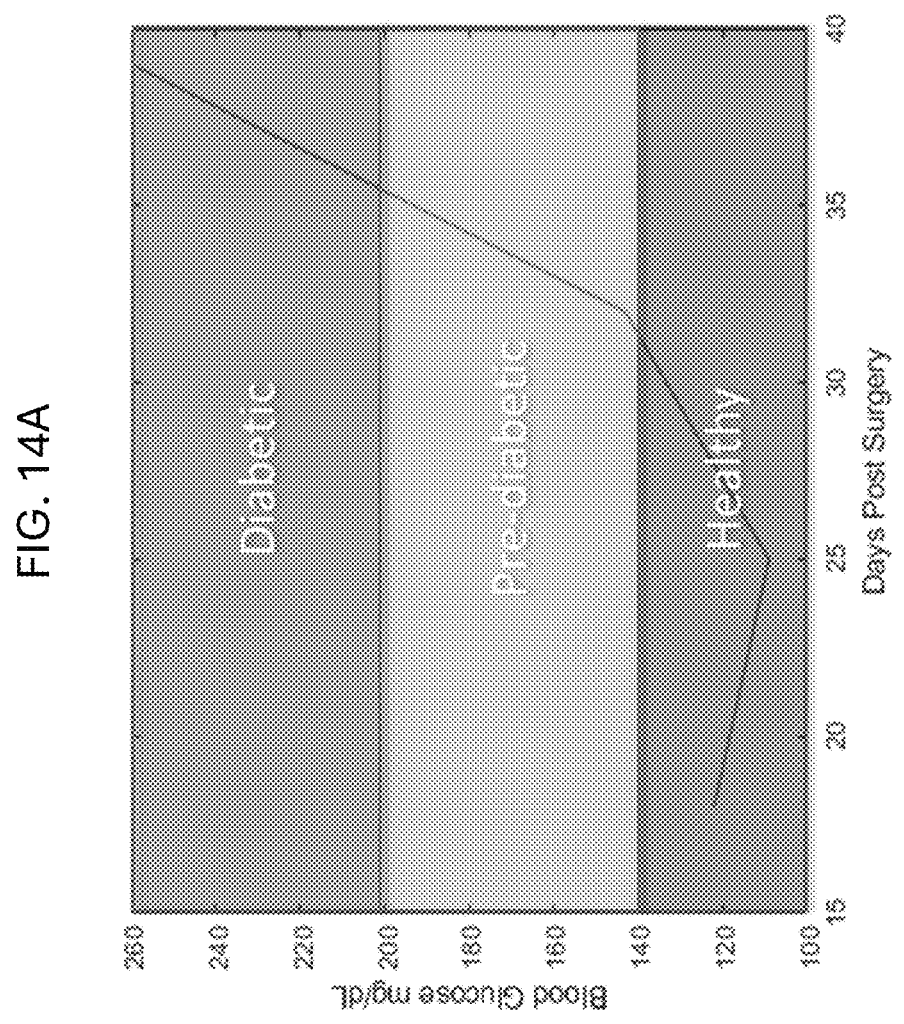
Figure 14B:
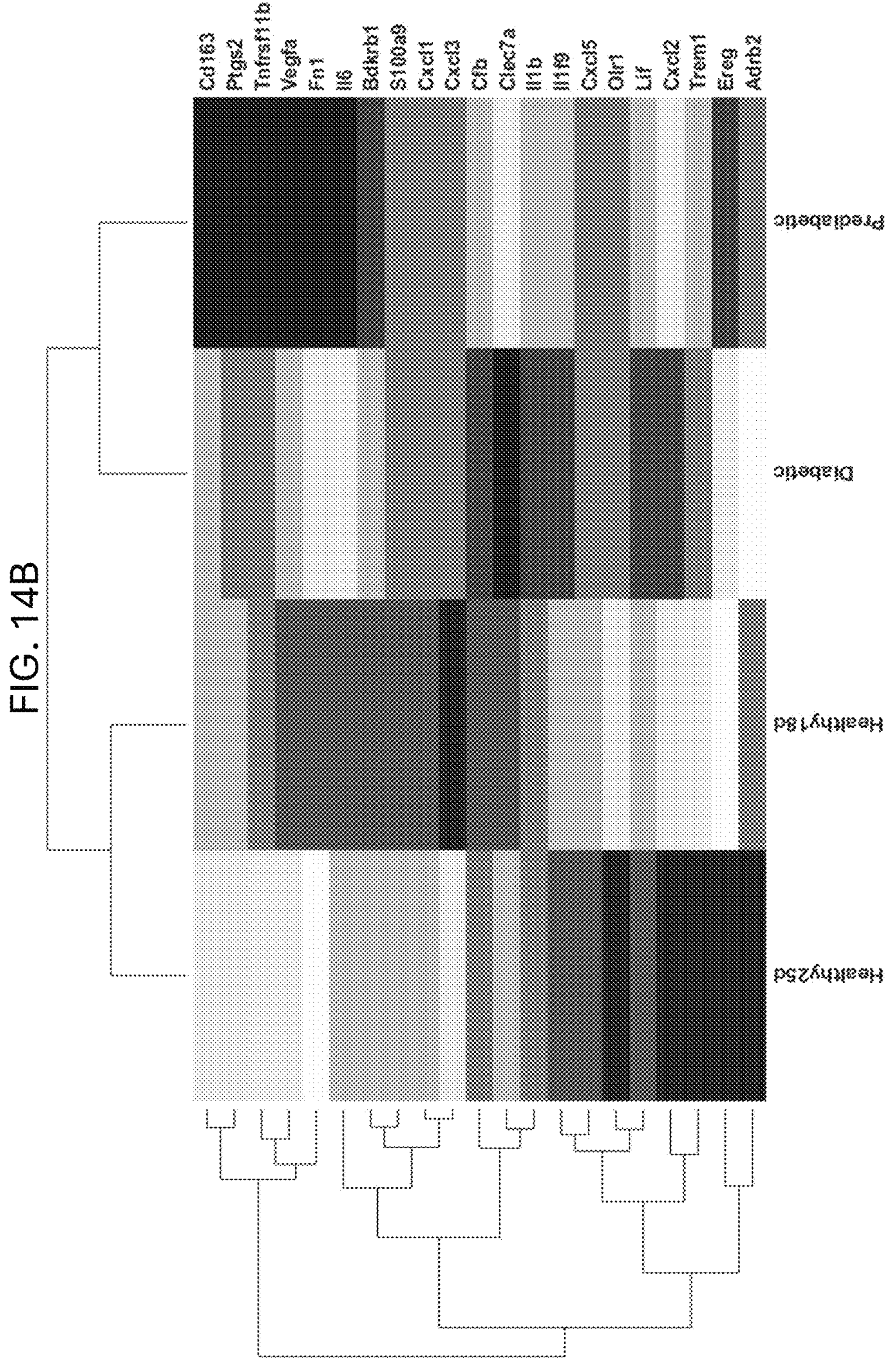
FIG. 14B is a heatmap of gene expression from the 21 genes made during the construction of a GES for diabetes.

Elastic net regularization enabled selection of 21 genes that reliably changed in scaffolds in disease: Cd163, Ptgs2, Tnfrsf11b, vegfa, Fn1, 116, Bdkrb1, S100a9, Cxcl1, Cxcl3, Cfb, Clec7a, Il1b, Il1f9, Cxcl5, Olr1, Lif, Cxcl2, Trem1, Ereg, Adrb2. Unsupervised hierarchal clustering was used to create a heatmap of gene expression from the niches of NOD mice (at the location of implanted scaffolds) that had disease in addition to time matched healthy controls. FIG. 14 is the heatmap of gene expression from the 21 genes.

The computational model described in Example 2 is applied. It is expected that the GES may be used to stage subjects as healthy, pre-diabetic or diabetic.

Example 10

This example demonstrates engineered immunological niches to monitor disease activity and treatment efficacy in relapsing multiple sclerosis.

Abstract: Relapses in multiple sclerosis can result in irreversible nervous system tissue injury. If these events could be detected early, targeted immunotherapy could potentially slow disease progression. We describe the use of engineered biomaterial-based immunological niches amenable to biopsy to provide insights into the phenotype of innate immune cells that control disease activity in a mouse model of multiple sclerosis. Differential gene expression in cells from these niches allowed us to monitor disease dynamics and to gauge the effectiveness of treatment. A proactive treatment regimen given in response to signal within the niche but before symptoms appeared substantially reduced disease. This technology offers a new approach to monitor organ-specific autoimmunity, and it represents a platform to analyze immune dysfunction within otherwise inaccessible target tissues.

Introduction: Autoimmunity can affect nearly every organ, and these diseases collectively have a prevalence of 15-24 million patients in the United States.[1] Treatment of autoimmune disease before irreversible damage occurs represents a substantial clinical opportunity, yet requires improvements in detecting disease activity and in understanding pathogenic mechanisms. For patients already diagnosed with an organ-specific autoimmune disease, the ability to reliably identify an immunological relapse could fundamentally change treatment approaches. Strategically administered pulses of treatment could obviate the need for lifelong immune suppression. The goal of this investigation was to develop a tool to monitor immune dysregulation occurring within target tissues in order to identify relapse onset and to predict its response to therapy.

Relapsing remitting multiple sclerosis (RRMS) causes accumulating disability due to autoimmune demyelination in the central nervous system (CNS). Sixty percent of patients with RRMS are unable to walk unassisted within 15 years of diagnosis.[2] While a growing arsenal of therapies have been shown to slow relapse rate, new lesion formation on magnetic resonance imaging (MRI) scans of CNS tissues, and disability progression in people with RRMS, an individual's response to one of these therapies can be highly variable.[3] Furthermore, such therapies have to be administered continuously over the long-term and frequently cause adverse effects. Finally, while the MRI shows areas of demyelination, it provides no information regarding the underlying immunopathology. Prior studies have shown divergent patterns of immune cell infiltration within MS lesions, implying that different immunotherapies could exert variable effects in different patients.[4,5] Clearly, a full characterization of the pathogenic local immune response within the CNS is the goal, yet remains impossible with current technologies.

We investigated the application of tissue engineering to create easily accessible, subcutaneous immunological niches that reflect aspects of immune status of CNS tissues using the mouse experimental autoimmune encephalomyelitis (EAE) model of MS. Porous materials implanted subcutaneously induced cell ingrowth and vascularization, with persistent extravasation of immune cells into the newly forming tissue. We hypothesized that these forming immunological tissues with chronic inflammation can serve as a niche with similar cell infiltrates and phenotypes to other inflammatory sites within the host. Moreover, we hypothesized that biopsy of these engineered immunological niches (IN) could detect changes associated with disease activity and could be used to monitor the response to therapy with high reproducibility.

Results

EAE Alters Gene Expression at Implantable Immunological Niche

Figures 19A, 19B:
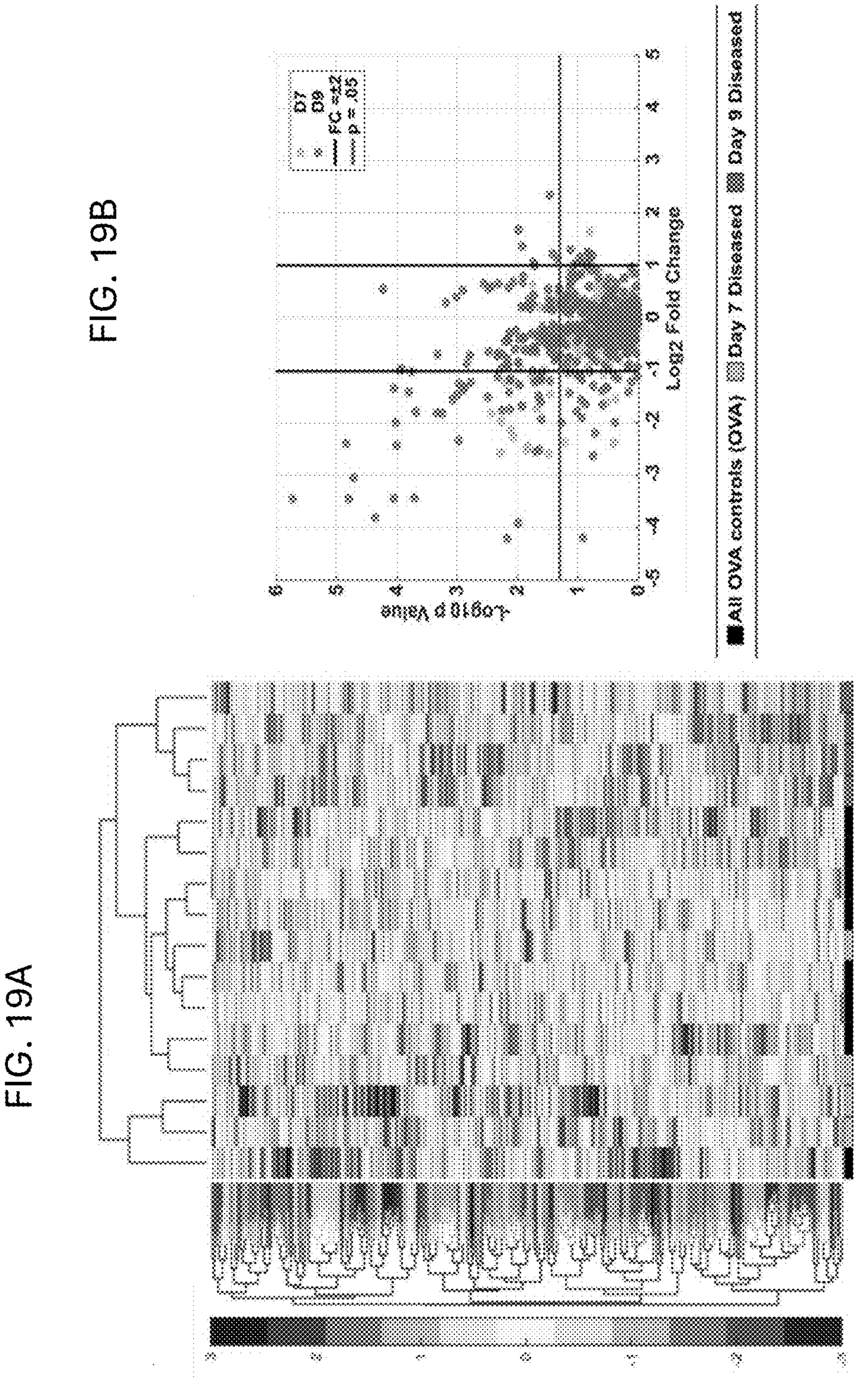
FIGS. 19A-19B show a Gene expression from entire OpenArray Panel.
Figures 20A, 20B, 20C:
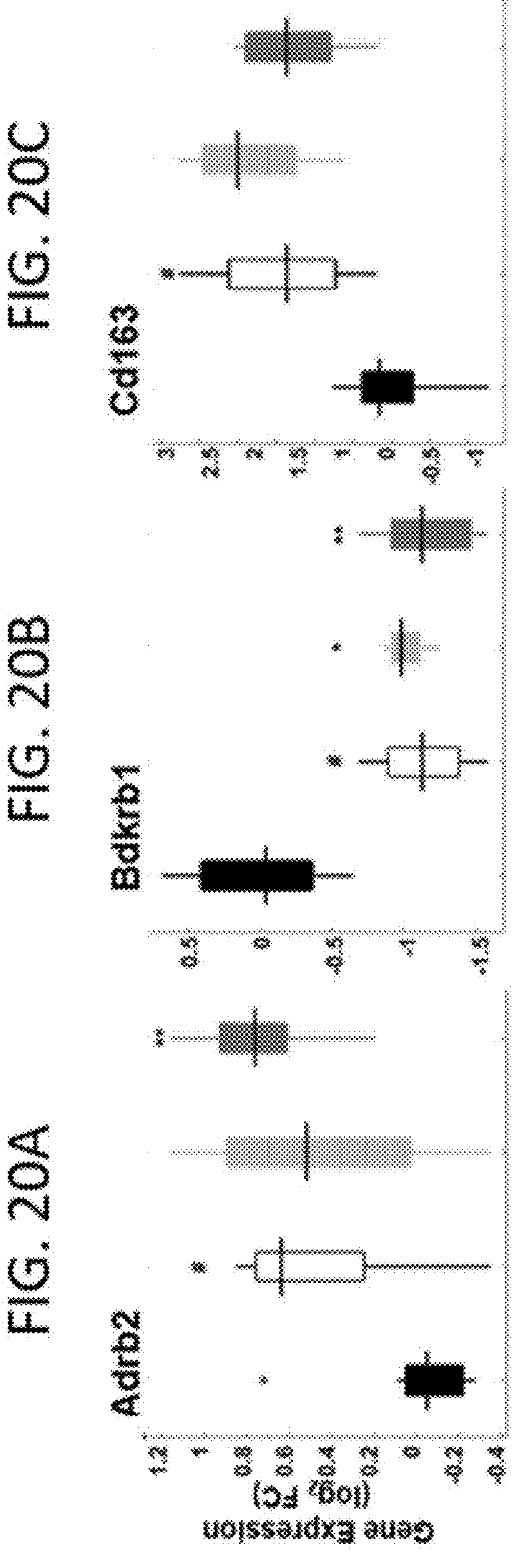
FIGS. 20A-20U show Gene expression from OpenArray for 21 genes in gene signature. $\text{Log}_2$ FC is displayed in boxplots with 25-$75^{th}$ percentiles and range of data for each group displayed (outliers indicated with +). Boxes demonstrate pooled OVA controls and diseased mice, while $2^{nd}$ to right most and right most boxes represent the $\log_2$ (fold change) at days 7 and 9, respectively. Two-way ANOVA was used to compare pooled OVA controls vs diseased mice (#p<0.05). A Bonferroni-corrected post-hoc multiple comparisons test was used to compare diseased to time matched controls (*p<0.05, **p<0.005).
Figures 20D, 20E, 20F:
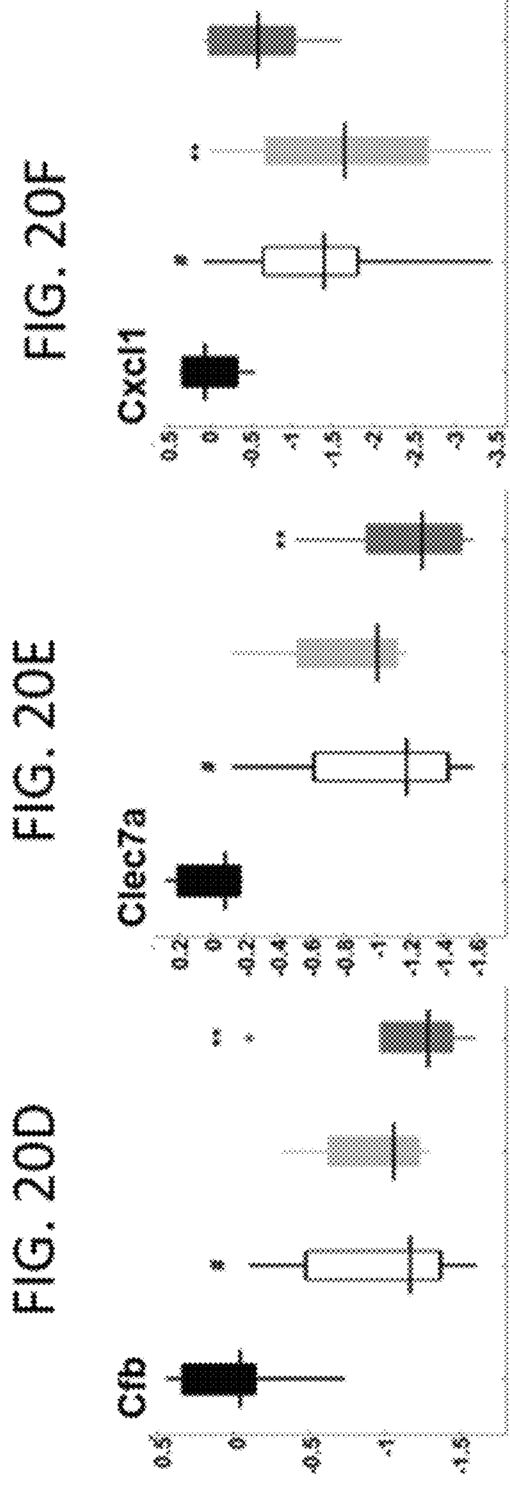
Figures 20G, 20H, 20I:
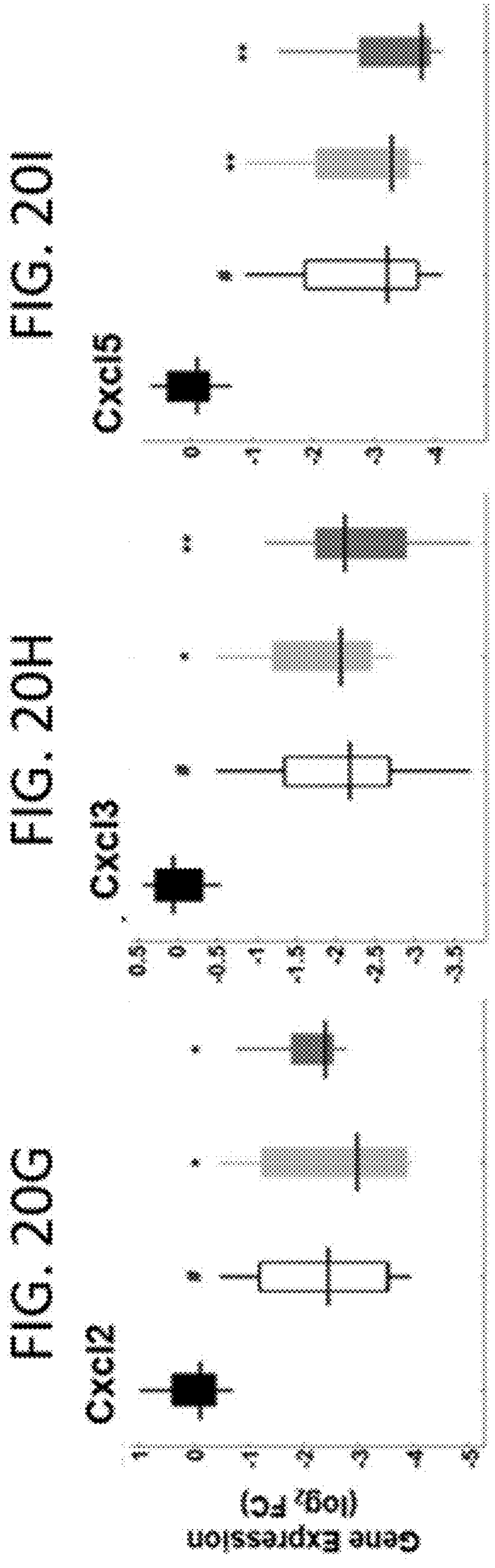
Figures 20J, 20K, 20L:
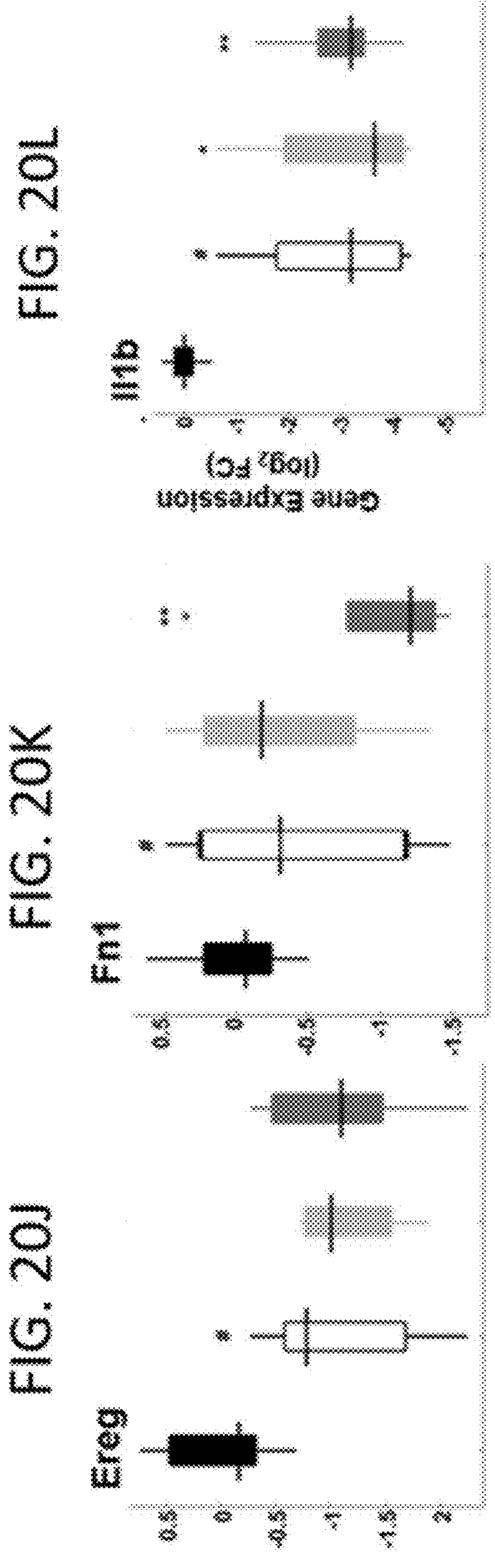
Figures 20M, 20N, 20O:
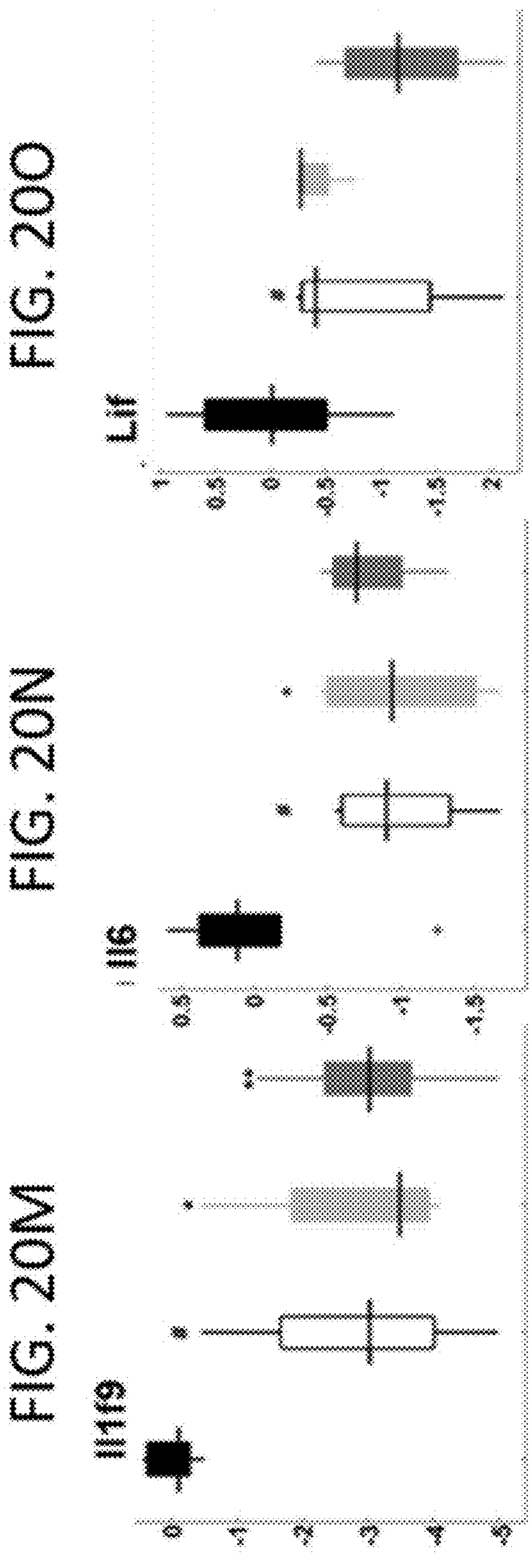
Figures 20P, 20Q, 20R:
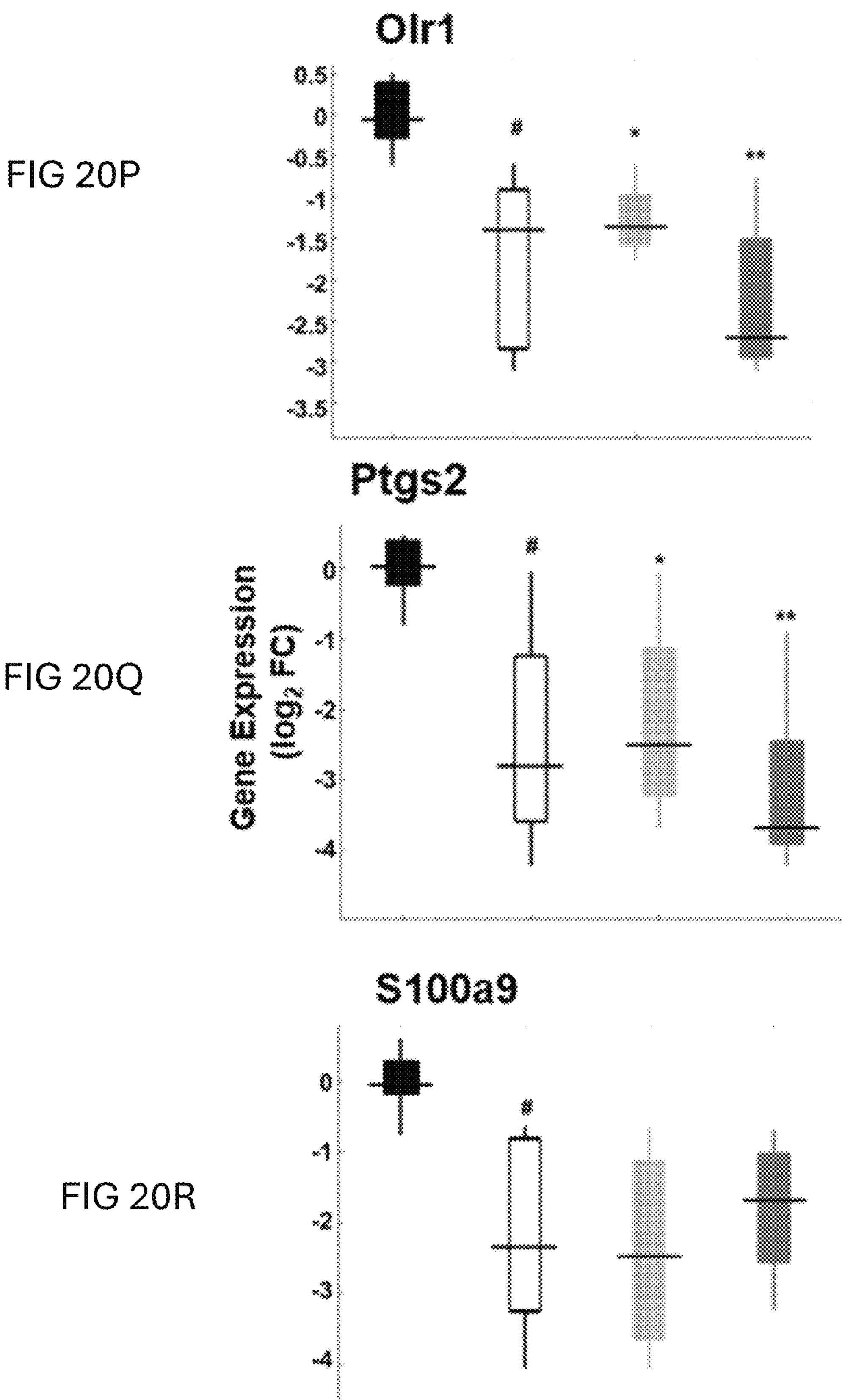
Figures 20S, 20T, 20U:
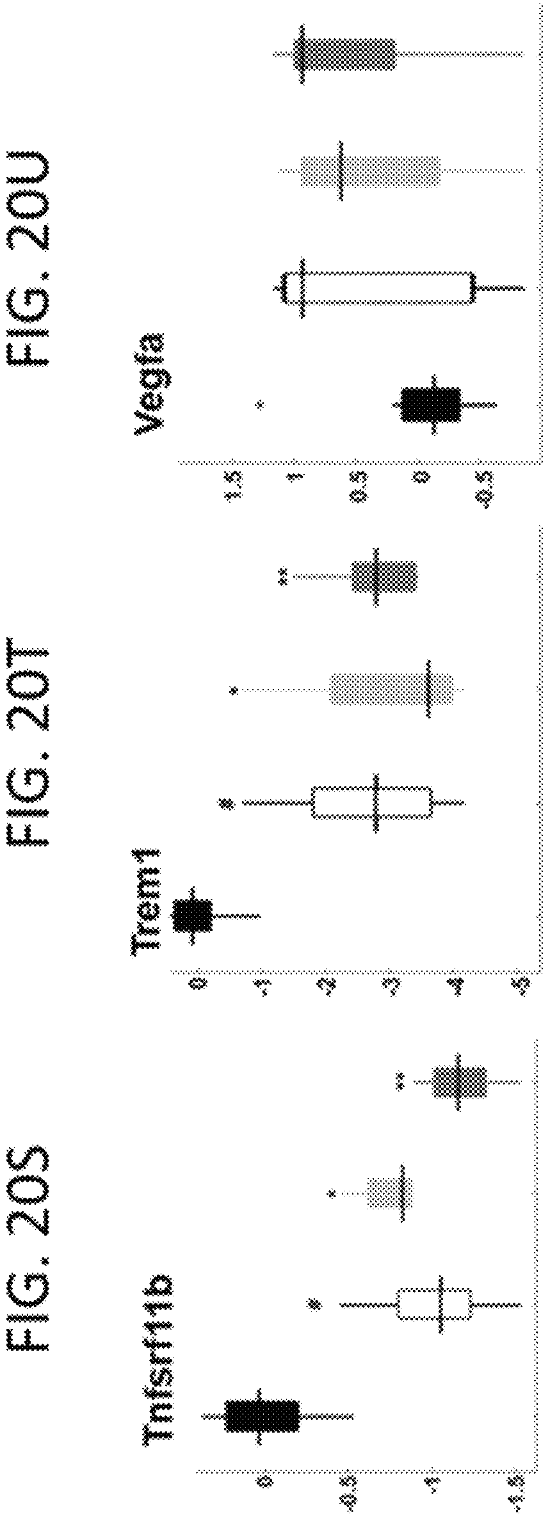

Microporous poly(ε-caprolactone) (PCL) scaffolds were implanted in the subcutaneous space of SJL mice 2 weeks before adoptively transferring either autoreactive or control T-cells (reactive to $PLP_{139-151}$ or $OVA_{323-339}$, respectively). Through day 7, no mice had symptoms of disease, yet by day 9, all EAE mice became symptomatic (FIG. 1*b*). INs were harvested and gene expression analyzed via the OpenArray high-throughput gene expression platform on days 7 and 9 (FIG. 1*a*). Analysis revealed that of the 632 genes analyzed, 130 were differentially expressed between control and diseased mice (time points pooled, n=8, $p<0.05$) (FIG. 19). Of genes that were differentially expressed, a combination of fold change (FC), expression stability, and elastic net regularization were used to identify 21 genes, one of which, TREM1, was previously unreported with regards to EAE or MS (FIG. 20). A radar plot of the $\log_2$FC for each of the 21 genes indicated similar patterns of expression between INs isolated from pre-symptomatic (d7) and symptomatic (d9) EAE mice that differ from those isolated from control mice. Additionally, unsupervised hierarchical clustering demonstrated that control mice and diseased mice cluster separately. Collectively, EAE is associated with numerous changes in gene expression at the immunological niches and these changes are detectable before disease symptoms occur.

Figures 21A, 21B, 21C:
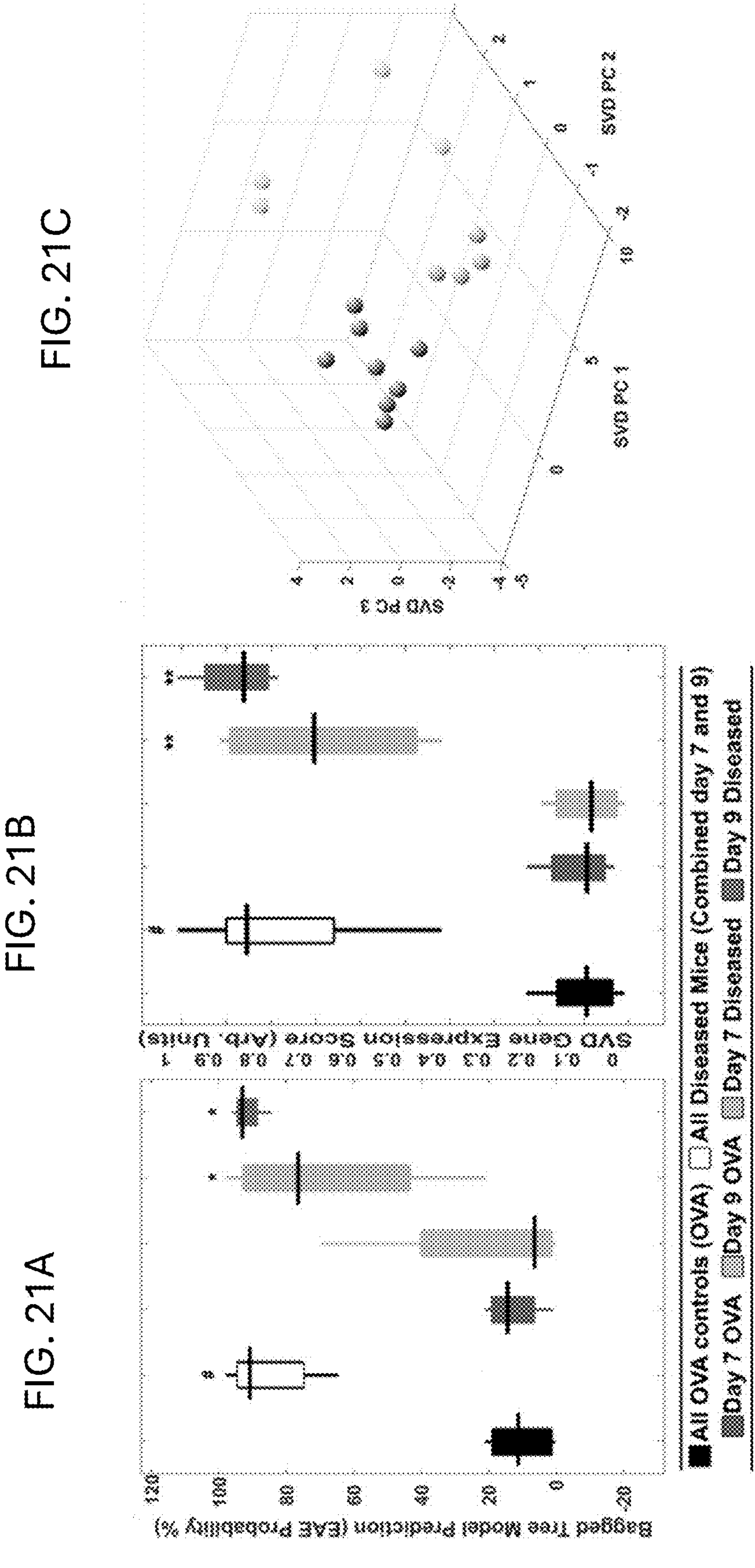
FIGS. 21A-21C demonstrate development of SVD and BT model enable classification of mice as healthy or diseased.
Figure 23:
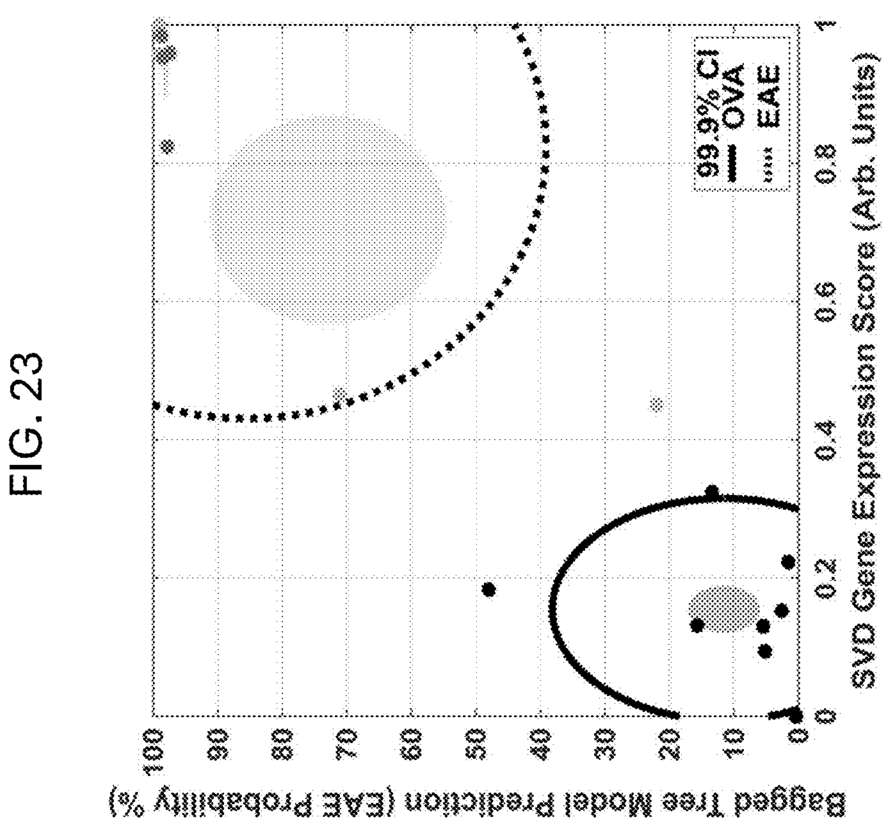
FIG. 23 shows gene expression analysis by qPCR confirms OpenArray findings. The same samples examined via OpenArray were analyzed in-house by qPCR in 384 well plates and signature scores plotted as bagged tree (BT) versus SVD. Black lines indicate 99.9% confidence intervals for pooled diseased or control mice. Filled ovals indicate mean (centroid) and standard error of the mean for each indicated group. Clearly, the results via qPCR indicate similar findings to OpenArray.
Figure 22:
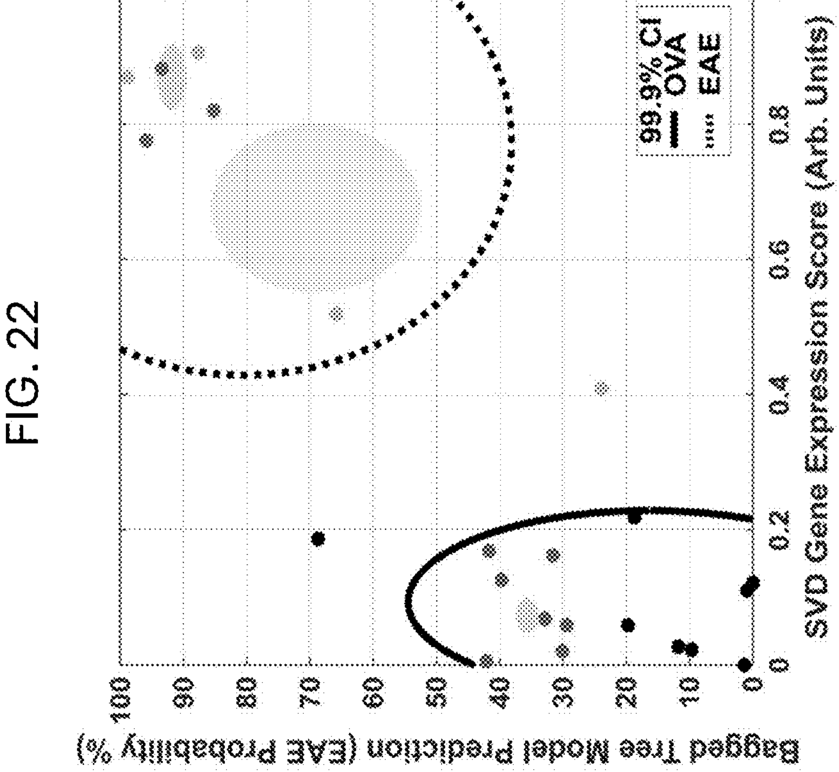

We next applied computational approaches to develop a scoring system from the 21 gene signature that could distinguish healthy from diseased mice. Two approaches were employed: an unsupervised dimensionality reduction approach, singular value decomposition (SVD); and a supervised machine learning algorithm, bootstrap aggregated decision tree ensemble (Bagged Tree or BT).[6,7] Results of the SVD and BT were similar and in both cases showed significant differences between control and EAE mice, regardless of time point (FIG. 21). These data formed the basis for our trained model for disease classification used throughout the study. A clear separation was observed between INs isolated from diseased and healthy mice by plotting the two scores. The signature scores are predictive of disease onset, as the animals at day 7 had no symptoms, yet a high signature score. The score also predicts disease severity. An in-house qPCR panel confirmed the OpenArray results and was employed throughout the study (FIG. 23).

Characterization of Populations within Immunological Niches and Blood

Cell populations within the INs were subsequently investigated using a panel of eight immune (CD45+) cells commonly involved in EAE.[8] Cells as a percentage of live CD45+ cells were measured, with substantial similarity between healthy and diseased mice, and only minor differences in CD4+ T cells at day 7, CD8+ T cells at day 9, and CD4+ T cells and NK cells at day 21. Collectively, the large changes in gene expression observed at the IN with disease were likely due to alterations in cell phenotypes within inflammatory microenvironments, rather than cell trafficking. The preponderance of CD45+ cells within the INs are innate immune cells, which are recruited to the CNS during EAE initiation and progression and contribute to damaging the tissue.[9-12] The IN may be sampling the phenotypic alterations of innate immune cells that extravasate into inflammatory environments during disease.

We tested the hypothesis that the phenotypic alterations captured by analysis of the engineered tissue represent local responses within a tissue that are not captured by analysis of blood. Over the last two decades, numerous studies have examined differential gene expression in the blood of patients with MS and healthy controls.[13-17] Although blood is a rich source of cells, most of these cells are not relevant to the immune responses occurring within the CNS, which may explain why the overall changes between diseased and healthy are modest and why at least half of differentially expressed genes have few ties to MS pathophysiology. The analysis of blood harvested from symptomatic EAE mice or OVA controls (d10) indicated that the mean expression of signature genes in the blood does not mirror that from the IN, suggesting that INs and blood provide distinct information. Unsupervised hierarchical clustering was unable to cluster diseased from healthy mice based on blood data; in fact, approximately 18% of samples did not have a valid reading from the blood, with some, such as Ereg, undetectable in most samples.

Immunological Niches are Dynamic with Disease State and Reflect Effectiveness of Therapy We next investigated the capacity of the IN to monitor disease dynamics that are associated with remission and relapse. Disease was induced by adoptive transfer (cells reactive to $PLP_{139-151}$ or $OVA_{323-339}$) and allowed to progress towards symptomatic remission before IN biopsy at day 21, and relapse was initiated by a second adoptive transfer of cells on day 23 reactive to another immunodominant epitope that simulates epitope spreading during relapse[18] (either $PLP_{178-191}$ or $OVA_{257-264}$). The second IN was biopsied at day 28 (relapse) (schematic and clustergram). Radar plots demonstrated that the $\log_2$ FC of the 21 signature genes at the remission time point were similar to control (FIG. 2*a*). During disease relapse, the genes exhibited similar expression to disease onset (FIG. 2*b*). When analyzed via the trained model, INs from relapsing mice demonstrated high BT and SVD scores, whereas those from animals in remission were similar to control mice (data normalized to time matched controls). Signature scores are dynamic and predict disease state, as demonstrated by the finding that only the remission time point demonstrated significantly different scores from the symptomatic onset scores. ROC curves were plotted to determine the diagnostic ability of the system and demonstrated an AUC of 0.98-1 (depending on metric: SVD, BT, or combined) (95% CI 0.94-1.03) for the training set, and an AUC of 0.81-0.90 95% CI 0.59-1.06) for distinguishing remission and relapse samples, validating the diagnostic efficacy of the signature score derived from INs in diagnosing and prognosing EAE. Collectively, this system offers the opportunity for a patient to be alerted of impending relapse, which would enable pharmacologic intervention to prevent or reduce severity of relapses.

Figures 24A, 24B:
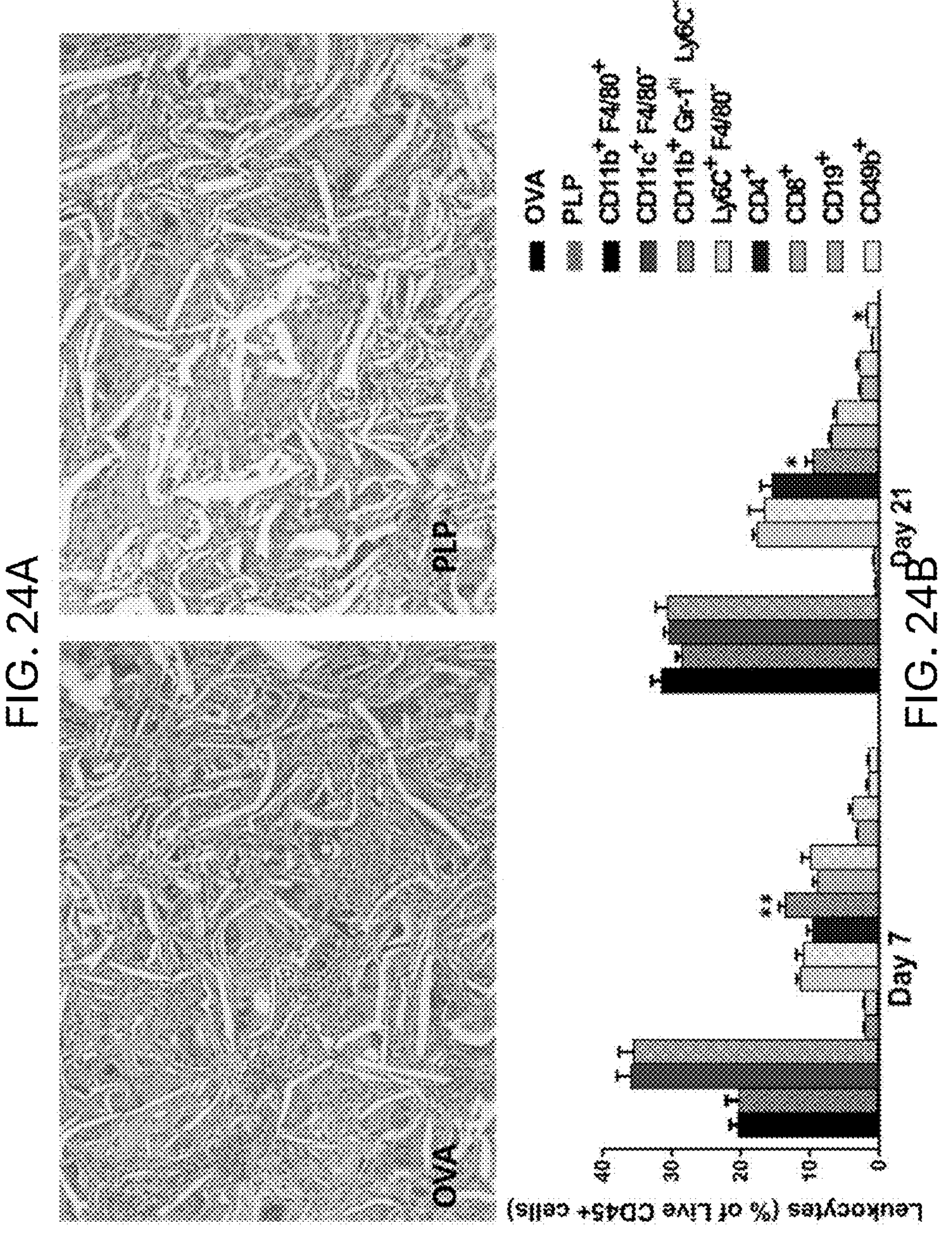
FIG. 24A-24B show an evaluation of immune cells within INs.
Figure 25A:
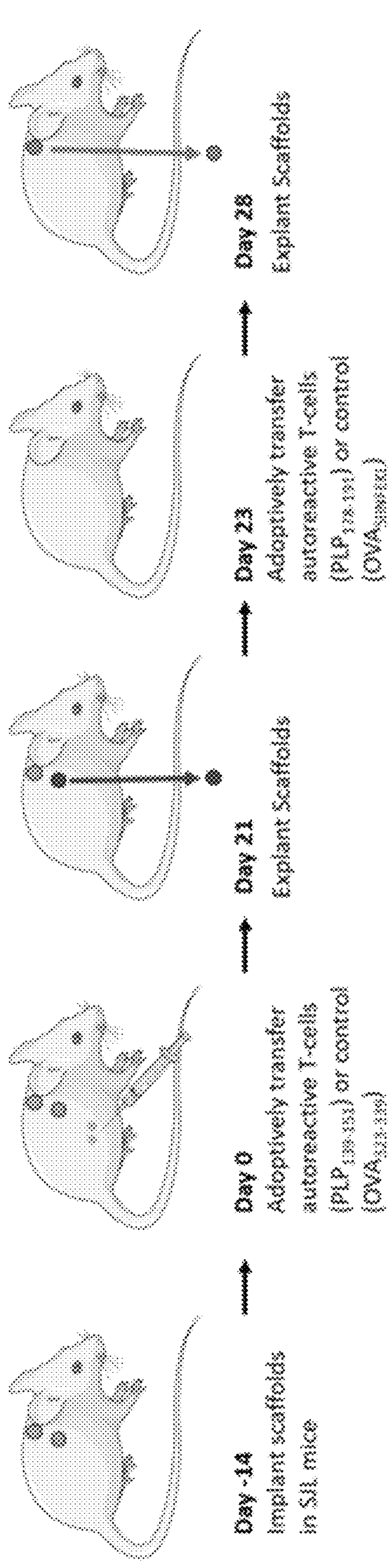
Figure 25B:
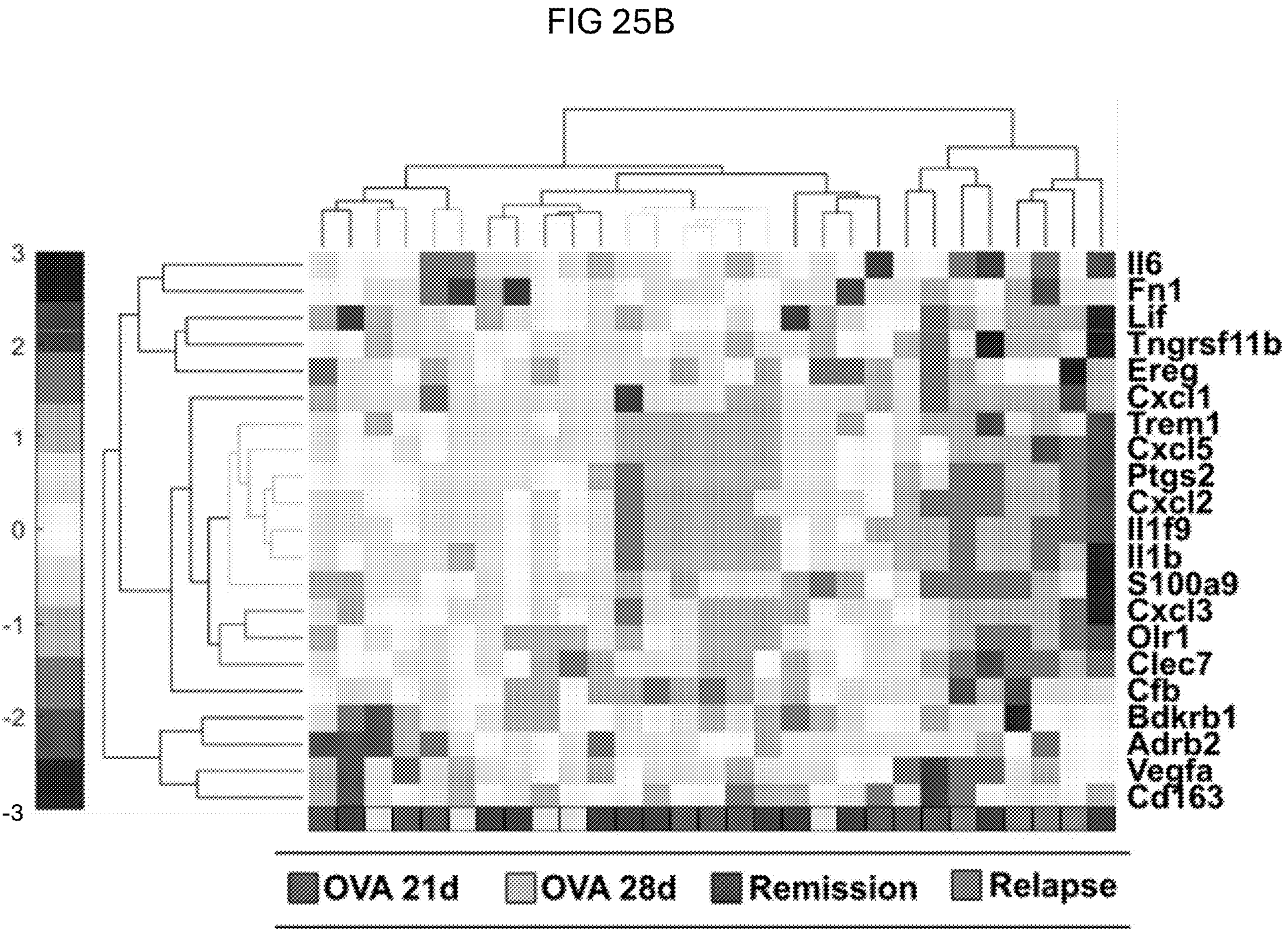
FIG. 25B) Heatmap and hierarchical clustering of 21 identified genes of interest, expression levels standardized by gene.
Figures 26A, 26B, 26C, 26D:
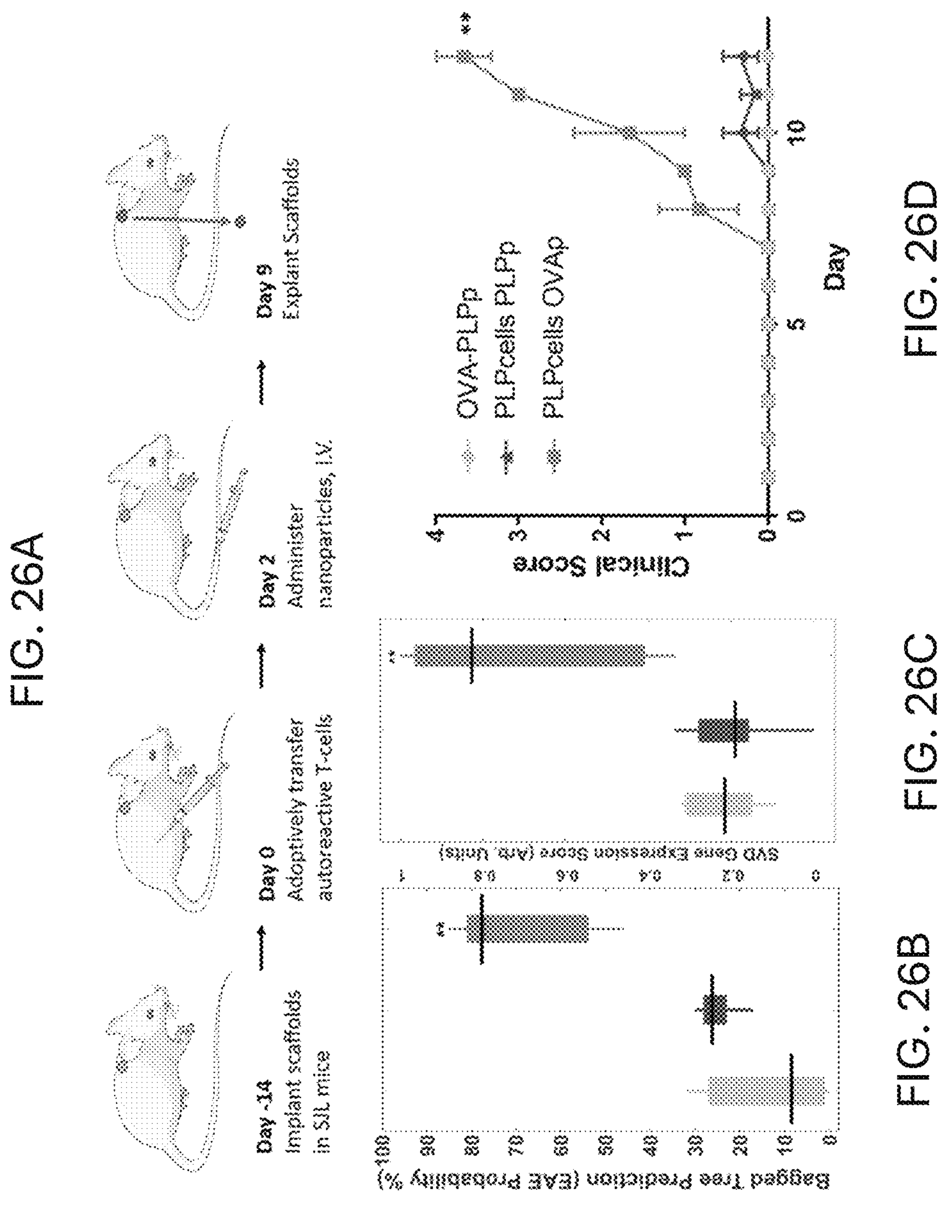
FIGS. 26A-26D show IN enables treatment monitoring for nanoparticle induced tolerance.
Figures 27, 28A, 28B, 28C:
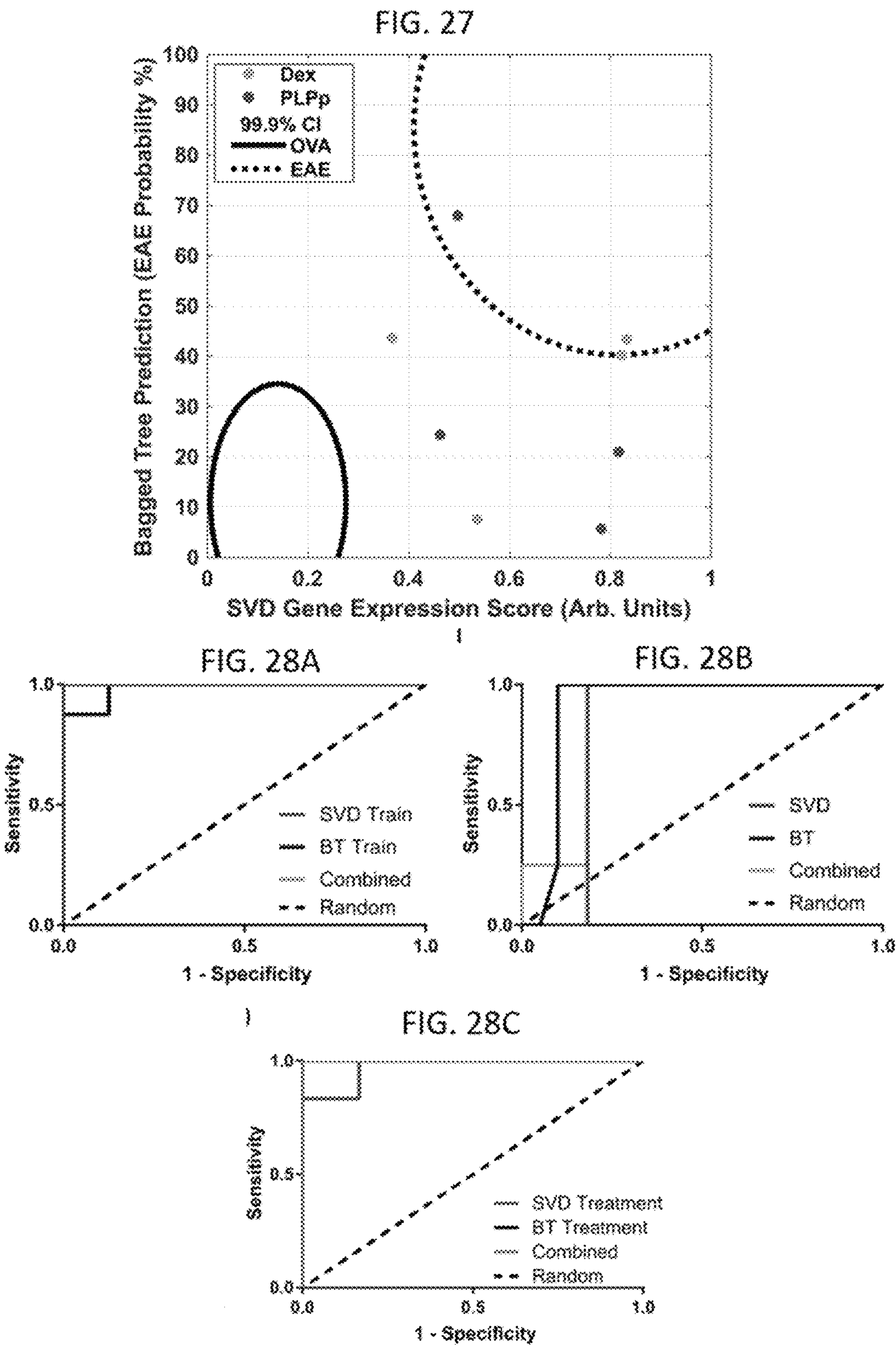
FIG. 27 demonstrates INs indicate disease onset and enable pre-emptive treatment. INs were implanted subcutaneously two weeks before adoptive transfer to induce disease. Seven days post-transfer INs were explanted and gene expression analyzed to plot BT score versus SVD which indicated that mice were developing disease. This information was used to enable pre-emptive treatment with either an I.V. injection of 2.5 mg PLGA nanoparticles encapsulating $PLP_{139-151}$ or daily I.P. injections of 5 mg/kg dexamethasone
FIGS. 28A-28C show ROC curves validate the signature scores from the IN as an effective diagnostic, prognostic, and treatment monitor. ROC curves were plotted for the disease onset data used to train the signature classification model (FIG. 28A), relapse and remission data (FIG. 28B), and particle treatments (FIG. 28C). In each case the area under each curve is >0.8 indicating successful diagnostic efficacy
Figure 29:
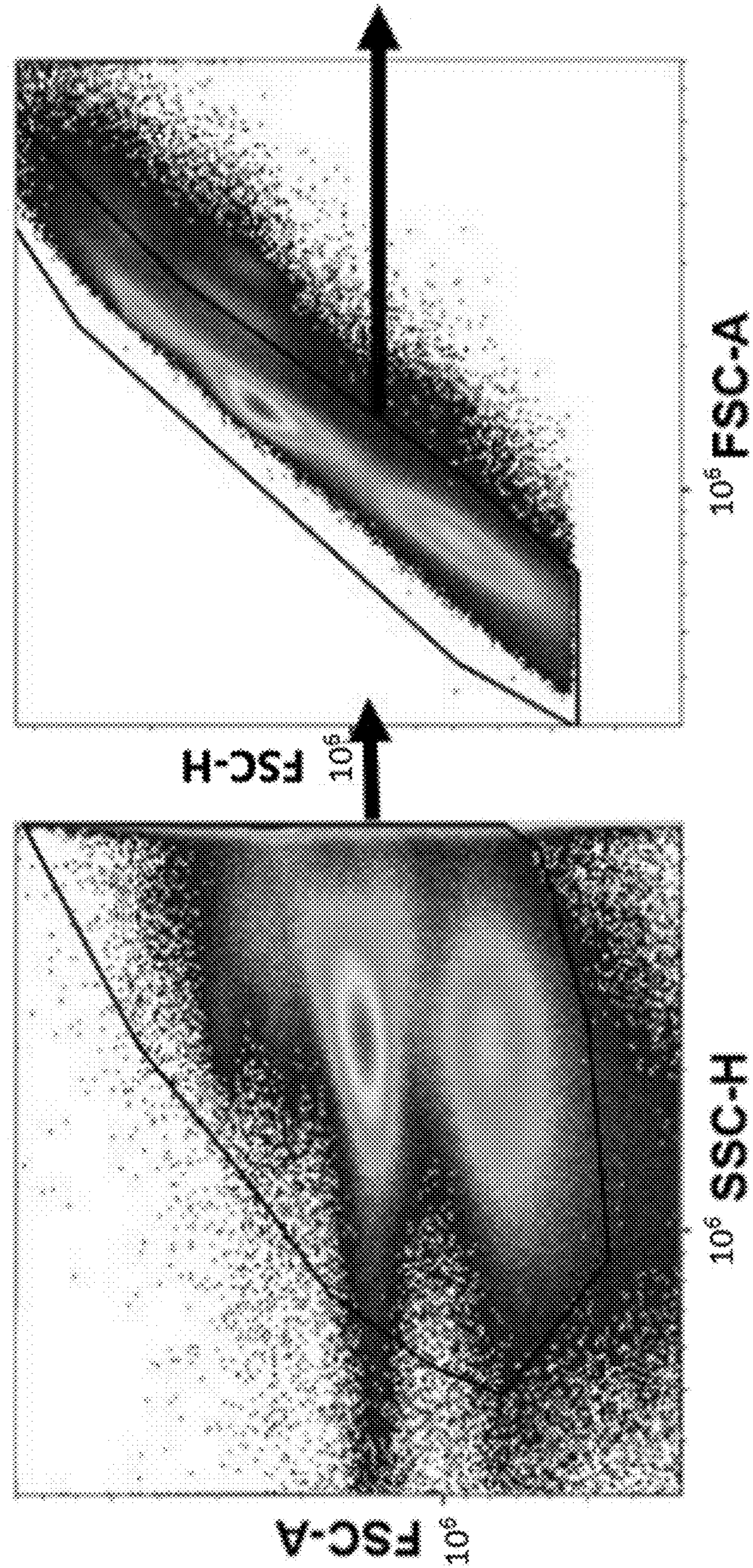
FIG. 29 shows a gating Scheme for innate immune panel. All samples were divided in half and half allocated to innate immune panel staining and half to adaptive. Cells were gated using forward scatter area and side scatter height before singlets were gated with forward scatter height and area. Within the singlet population CD45+, live cells (dead cell negative) stains were gated. At this point, CD11b and F480 were plotted to enable selection of CD11b+F4/80+ cells and subsequent analysis. The CD11b+ gate was used to select Ly6C and Gr-1 to enable the selection of CD11b+Gr-1+ Ly6C-cells. Then the F4/80 was plotted against Ly6C to enable selection of F4/80-Ly6C+ cells. Finally F4/80 was plotted with CD11c to enable selection of F4/80-CD11c+ cells. Arrows indicate flow of gating and texts indicates final cell populations used for analysis.
Figure 29:
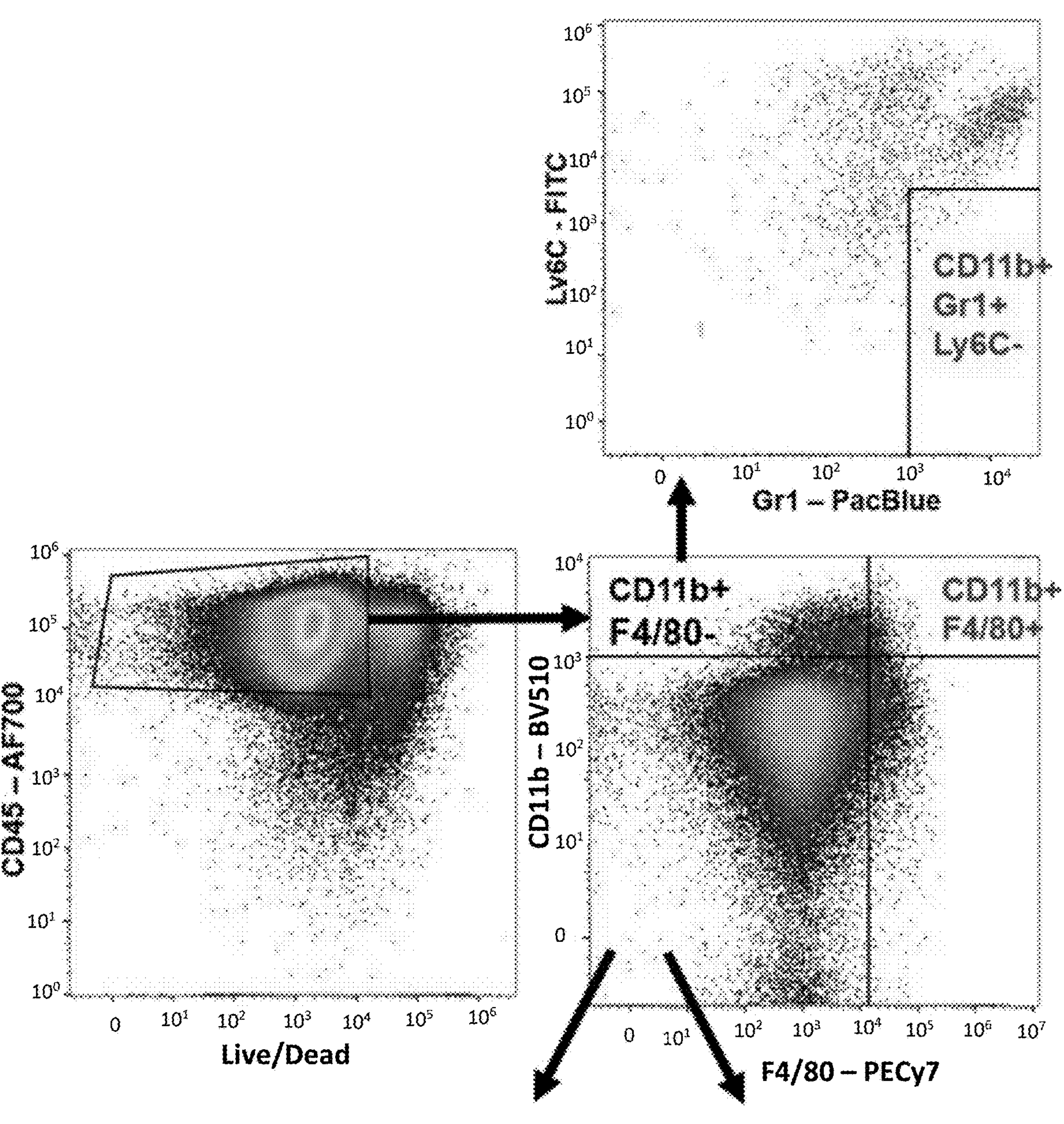
Figure 30:
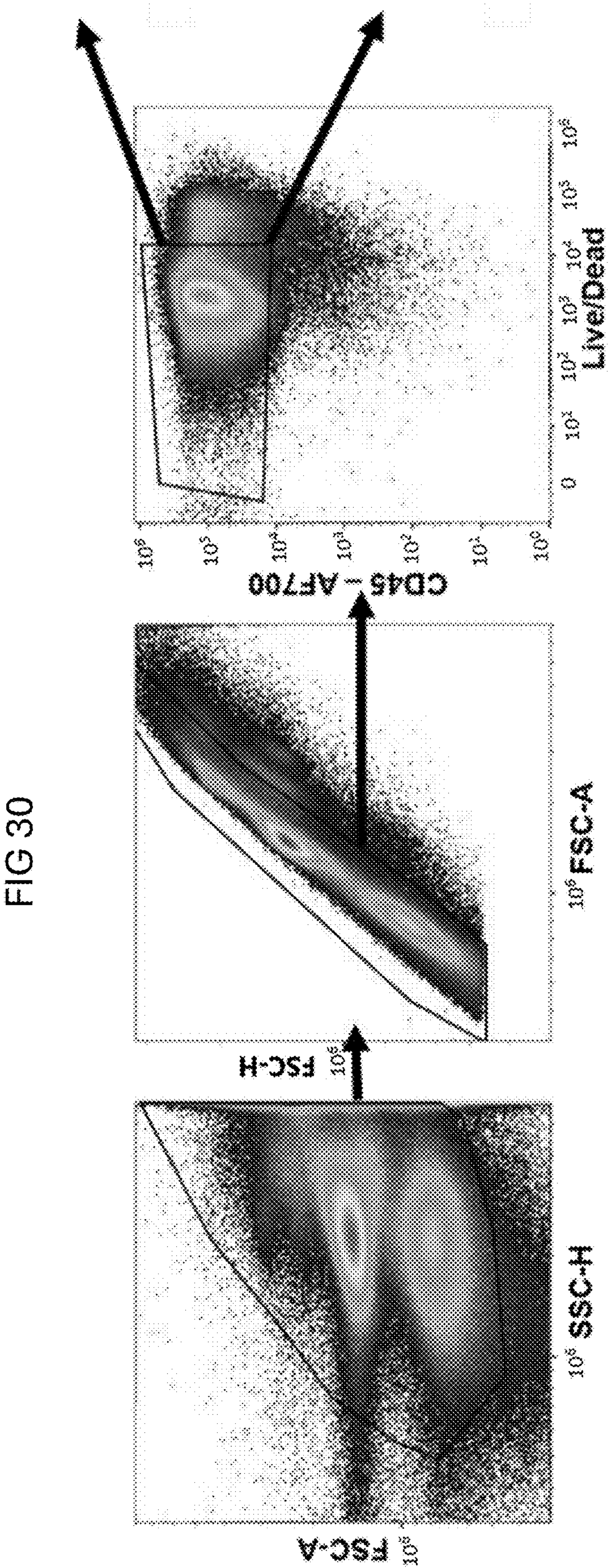
FIG. 30 shows a gating Scheme for adaptive immune panel. All samples were divided in half and half allocated to innate immune panel staining and half to adaptive. Cells were gated using forward scatter area and side scatter height before singlets were gated with forward scatter height and area. Within the singlet population CD45+, live cells (dead cell negative) stains were gated. At this point, CD4 and CD8 were plotted to enable selection of CD4+ or CD8+ cells. Next CD19 and CD49B were plotted to select the CD19+ and CD49b+ populations. Arrows indicate flow of gating and texts indicates final cell populations used for analysis.

We sought to test the ability of the implantable INs to monitor the response to therapy. We have previously reported nanoparticles to induce tolerance in these and similar models, which were employed here as a model treatment.[19-21] Similarly to previous studies, IN-implanted mice received an adoptive transfer of T cells, yet were also injected intravenously with 2.5 mg of antigen encapsulating PLG nanoparticles 2 days post-transfer. Three groups were used: a control group (OVA reactive T-cells and PLP particles), an effective treatment group (PLP reactive T-cells with PLP particles), and an ineffective treatment group (PLP reactive T-cells and OVA particles). INs were biopsied on day 9 and analyzed for the gene signature, which indicated that the effective treatment group had similar signature score and clinical score as the control group. However, the ineffective treatment group had significantly higher signature and clinical scores relative to the control (FIG. 24). The pattern of gene expression in the mice receiving ineffective treatment was similar to the untreated mice during disease onset. To estimate the diagnostic efficacy for treatment monitoring, ROC curves of SVD, BT, and a combined metric were created with AUC values of 0.97-1 (95% CI 0.89-1.06), suggesting a highly effective treatment monitoring tool.

Preemptive Intervention Enabled by Early Detection Abrogates Disease.

Finally, we sought to test the hypothesis that pre-emptive intervention enabled by the INs ability to predict disease onset prior to clinical symptoms would improve outcomes. We induced EAE and biopsied INs for analysis seven days post-transfer, before delivering therapies: either a single i.v. dose of 2.5 mg of antigen encapsulating PLG nanoparticles (described below) or a daily i.p. injection of 5 mg/kg dexamethasone. In either case, the IN alerted to immune dysfunction that differed from healthy and enabled pre-emptive interventions to reduce clinical symptoms and prevent disease onset (FIG. 3*c*).

Discussion

We developed an implantable IN that forms a vascularized inflammatory tissue that is dynamic with the status of the immune system. This finding is well supported by reports demonstrating that inflammation surrounding implants is altered by systemic changes associated with various physiological and pathological states, including diabetes, obesity, and advanced age.[22-24] This implantable biopsy site thus harnesses the host immune system to identify immunological changes within innate immune cells of tissues, which contribute to disease initiation and progression. We identified 21 molecular targets that are differentially expressed at the IN in diseased animals that represent onset or relapse of EAE or MS, enabling interventions to prevent disease development before damage occurs. Furthermore, the molecular details gleaned from biopsy of the IN enables pre-emptive treatment, a strategy which could be transformative in treating RRMS patients before relapses occur, with the potential to prevent disease altogether.

In addition to aiding in patient monitoring, the IN is a tool that can provide molecular information on the dysfunctional immune cells within inflamed tissues, and may enable a precision medicine approach for improved subtyping of MS and provide indicators for factors associated with progression.[25] Multiple pathological features can underpin MS in different patients, yet, at present, identifying the sub-types can only occur post-mortem. With this IN, molecular information about responses within the tissue could be used to screen individual patients and correlate responses to disease outcomes in addition to therapeutic responses, to enhance prognosis. In contrast to blood glucose monitors for Type 1 Diabetes that monitor treatment of established disease, this immunological niche sets the stage for an implantable molecular sensor that continuously reports on the functional status of the immune system to inform disease onset, prognosis, and treatment monitoring.

Method

Scaffold Fabrication and Subcutaneous implantation—Microporous scaffolds were prepared in the same manner as previously described.[8,26] All procedures were performed in accordance with the regulations approved by the Animal Care and Use Committee of the University of Michigan. Female SJL/J mice were purchased from Envigo at an age of six weeks. Mice were anesthetized with isofluorane, before subcutaneous implantation as previous described.[27,28] Mice received subcutaneous injections of carprofen (5 mg/kg) immediately before surgery and 24 hours after surgery.

Adoptive transfer of T cells—Donor mice were immunized as described previously.[29] Briefly, an emulsion was prepared containing 1:1 complete Freund's adjuvant (incomplete Freund's adjuvant [Fisher] with 4 mg/ml heat killed *M. tuberculosis* H37 Ra [Fisher]): PBS with 2 mg/ml peptide ($PLP_{139-151}$ or $OVA_{323-339}$ [Genscript]). A total volume of 100 μL CFA with peptide was injected subcutaneously at three sites within each donor mouse. 10 days later, donor mice were euthanized and spleens and lymph nodes (inguinal, axiallary, and brachial) were harvested before processing into a single cell suspension. Cells were cultured in RPMI with 10% FBS, 2 mM L-glutamine, 100 IU/mL penicillin, 0.1 mg/ml streptomycin, 1× non-essential amino acids solution, 1 mM sodium pyruvate, 10 mM HEPES, and 20 μg/mL peptide antigen. After three days of culture non-adherent cells were harvested, counted, and injected i.p. into recipient mice. For most studies, 30 million cells were injected per mouse, but this inevitably led to some mice becoming moribund, so for remission studies, only 15 million cells were injected. To induce relapse, the same procedure was followed for preparation of cells reactive to either $PLP_{178-191}$ or SIINFEKL, and 25 million cells were injected i.p. After induction of disease, severity was monitored on a 0-5 scale as previously described[21]: 0=no disease, 1=hindlimb weakness or limp tail, 2=hindlimb weakness and limp tail, 3=partial hindlimb paralysis, 4=total hindlimb paralysis, 5=moribund.

Tissue isolation—To harvest biopsies of PCL implants for analysis, mice were anesthetized with isoflurane before an incision was made over the surface of the implant. The implant and any adherent encapsulating tissue were pulled through the incision and excised and the incision was closed with sutures. Tissues for RNA were flash frozen in isopentane on dry ice and stored at −80° C. until analysis. Tissues for flow cytometry were placed into PBS and stored on ice, and tissues for histology were immediately placed in 4% paraformaldehyde. For blood isolation, mice were anesthetized before intracardiac blood draw with EDTA. RBCs were lysed in an ACK solution (Gibco) before washing in PBS. Pellets were resuspended in Trizol and stored at −80° C. until analysis.

RNA isolation and cDNA synthesis—RNA was isolated with the Directzol RNA Miniprep kit (Zymo Research) following manufacturer's instructions. Samples to be used for OpenArray analysis were also assessed for RNA integrity (RIN) with an RNA fragment analysis with an RNA 6000 Nano Kit (Agilent Technologies), and all samples had a RIN>8.

cDNA synthesis was performed with the SuperScript™ VILO™ CDNA Synthesis Kit (ThermoFisher Scientific) according to manufacturers instructions. RT was performed with RNA concentrations of 200 ng/μL. Because RNA isolates from blood typically did not achieve this concentration, an RNA clean-up kit was used to increase concentration and purity according to manufacturer instructions (RNA Clean & Concentrator-5, Zymo Research).

OpenArray High-Throughput RT-qPCR—For high-throughput gene expression analysis, OpenArray panels focused on mouse inflammatory pathways were used. Panels and accompanying reagents were purchased from ThermoFisher (Applied Biosystems™ TaqMan™ OA Mouse Inflammation Panel, Cat. No. 4475393). The panels contained 632 validated genes that have known roles in inflammation as well as 16 endogenous controls (housekeeping genes). cDNA was prepared as described above and OA analysis and quality control was performed on a fee-for-service basis by the UM DNA Sequencing core. The core uses a robotic OA AccuFill system and the QuantStudio 12k Flex RT-PCR system (ThermoFisher Scientific). Analysis was performed as previously described using this system (Oakes 2019). For OpenArray a total of n=8 samples per condition (diseased or healthy) were analyzed with 4 from each time point (day 7 or 9), and each sample was from an independent mouse and samples alternated between healthy and diseased in their placement on the chip to minimize spatial bias.

Selection of Genes of Interest—Samples were analyzed first to remove genes that did not have readable data in more than one of the four mice in each condition. Next, any samples that were missing data were filled with the median for the overall dataset. This was required because downstream analysis requires complete matrices. Ultimately, 500 genes of the 648 were used for this study. Each of the 16 reference genes were analyzed via the NormFinder algorithm to select the three most stable reference genes: Hmbs, Polr2a, and Ubc. $\Delta C_q$ values were calculated for each gene from the average of the reference genes for that sample. Next, fold change (FC), p-values, and prediction scores derived from elastic net regularization (MATLAB's lasso function, $\alpha=0.01$, leave one out cross-validation) were calculated for each gene using time-matched controls.[29] Boxplots show $\log_2 FC$, centered on the median of the time matched healthy controls. All identified 21 genes of interest were identified as predictors (elastic net scores>0), had FC>1.5, and p<0.05. Additionally, we attempted to include genes that increased and decreased during disease to make the model more robust and ease the eventual construction of a sensor.

Once these genes of interest were identified, all other studies were conducted via RT-qPCR analysis in 384 well plates. The same TaqMan probes used in the OpenArray chips were ordered from ThermoFisher Scientific and samples were alternated between healthy and diseased in their placement on the plate. TaqMan Gene Expression Mastermix was used and a final volume of 9 μl was used for each well of the 384 well plate. RT-qPCR was performed on the QuantStudio ViiA 7 system and $C_q$ values determined by the accompanying software. Non-detects were left blank for any statistical analyses, but were filled with the median of all samples for SVD (because it requires complete matrices). Samples from the original OpenArray data were run on every 384 well plate to allow for a correction factor to be applied to account for variability.

Gene Signature Scores and analysis—Firstly, unsupervised hierarchical clustering analysis was performed using MATLAB's clustergram tool which plots dendrograms to indicate samples and genes that cluster together. Ultimately, 21 genes of interest were identified, and computational approaches were used to create two metrics for evaluating whether mice were sick or healthy. Singular value decomposition (SVD) using MATLAB's svds function was applied to create a gene signature score using an unsupervised technique. Next, a supervised machine learning approach bootstrap aggregated decision tree ensemble (Bagged Tree) was trained to classify samples as healthy or diseased. We employed MATLAB's fitcensemble function with the Bag method.

Histology—For histological analysis, samples were excised and stored immediately in 4% PFA overnight to fix the tissue before being bisected and transferred to the University of Michigan In Vivo Animal Core for sectioning and staining with hematoxylin and eosin using standard protocols. Images were taken at 20× within the thickness of the IN.

Flow cytometry—INs were prepared for flow cytometry using previously described protocols.[8,30] Briefly, samples were minced with a scalpel and incubated for 20 minutes in Liberase TL (Roche) at 37° C. INs were then mashed through a 70 μm filter which was washed extensively with FACS buffer: PBS (Life Technologies) with 0.5% Bovine Serum Albumin (Sigma Aldrich) and 2 mM EDTA (Gibco). Cells were equally split into two tubes to enable staining and analysis of innate and adaptive immune cells from the same IN and then blocked with anti-CD16/32 (1:50, clone 93, e Bioscience). Each tube was stained with Live/Dead Fixable Red (Life Technologies) and Alexa Fluor® 700 anti-CD45 (1:125, clone 30-F11, Biolegend). The adaptive immune panel was also stained with: FITC anti-CD8 (1:25, clone 53-6.7, Biolegend), Pacific Blue™ anti-CD19 (1:100, clone 6D5, Biolegend), PE-Cy7 anti-CD49b (1:30, clone DX5, Biolegend), and V500 anti-CD4 (1:100, clone RM4-5, Biolegend). The innate immune panel was also stained with: APC anti-CD11c (1:80, clone N418, Biolegend), FITC anti-Ly6C (1:100, clone HK.14, Biolegend), Pacific Blue™ anti-Ly-6G/Ly-6C (Gr-1) (1:70, clone RB6-8C5, Biolegend), PE-Cy7 anti-F4/80 (1:80, clone BM8, Biolegend), and V500 anti-CD11b (1:100, clone M1/70, BD Biosciences). Samples were analyzed on a Cytoflex Cell Analyzer, and all single color controls and FMOs were used to aid with gating and compensation.

Nanoparticle Fabrication and Administration—Peptide encapsulating nanoparticles were fabricated with the double emulsion method as previously described.[31] Briefly, 150 μL of antigen dissolved in PBS (50 mg/mL $PLP_{139-151}$ or $OVA_{323-339}$ [Genscript]) was added to 2 mL of 20% w/v poly(lactide-co-glycolide) (inherent viscosity: 0.17 dL/g, Lactel). This solution was sonicated for 30 seconds before the addition of 10 mL of 1% w/v poly(ethylene-alt-maleic anhydride) in water. This was again sonicated to form the double emulsion which was poured into 200 ml of 0.5% w/v poly(ethylene-alt-maleic anhydride) and stirred overnight. Particles were washed extensively before lyophilization in cryoprotectant. The size and zeta potential of the acNPs were determined by dynamic light scattering (DLS) by mixing 10 ml of a 25 mg/ml particle solution into 990 mL of MilliQ water using a Malvern Zetasizer ZSP.

For treatment studies, mice were implanted with INs and 14 days later adoptively transferred with 30 million T cells. Two days, post-transfer, mice received a single bolus i.v. injection of 2.5 mg $PLP_{139-151}$ or $OVA_{323-339}$ loaded nanoparticles. Mice were monitored daily for symptoms of EAE, and INs were removed on day 9.

Statistics-All statistics were calculated with MATLAB or GraphPad Prism software. When comparing pooled control vs diseased mice, two-way ANOVA was used to determine significance. A post-hoc multiple comparisons with a Bonferroni correction was then used to compare each time point to its time-matched control. When comparing the scores of EAE mice over time a one-way ANOVA with a Bonferroni corrected post-hoc multiple comparisons test was used. Additionally, the same method was used to compare the three particle treated groups at a single time point. Student's t-tests were used to analyze flow cytometry data as comparisons were made between healthy and diseases within each time point (no comparisons over time). ROC curves were plotted and analyzed in GraphPad. Box plots show the median, 25th-75th percentiles and most extreme data points not considered outliers (outliers are indicated by +).

REFERENCES

The following references are cited throughout the Background and Examples 1-9 according to the number below.

[1] E. Zerhouni, Progress in Autoimmune Diseases Research Progress in Autoimmune Diseases Research, 2005. doi: 10.1038/80110.

[2] D. Miller, F. Barkhof, X. Montalban, A. Thompson, M. Filippi, Clinically isolated syndromes suggestive of multiple sclerosis, part I: natural history, pathogenesis, diagnosis, and prognosis, Lancet Neurol. 4 (2005) 281-288. doi:10.1016/S1474-4422 (05) 70071-5.

[3] M. Sospedra, R. Martin, Immunology of Multiple Sclerosis, Annu Rev Immunol. 23 (2005) 683-747. doi:10.1146/annurev.immunol.23.021704.115707.

[4] M. Rovaris, C. Confavreux, R. Furlan, L. Kappos, G. Comi, M. Filippi, Secondary progressive multiple sclerosis: Current knowledge and future challenges, Lancet Neurol. 5 (2006) 343-354. doi:10.1016/S1474-4422 (06) 70410-0.

[5] C. N. Fawaz, I. S. Makki, J. M. Kazan, N.Y. Gebara, F. S. Andary, M. M. Itani, M. El-Sayyed, A. Zeidan, A. Quartarone, H. Darwish, S. Mondello, Neuroproteomics and microRNAs studies in multiple sclerosis: Transforming research and clinical knowledge in biomarker research, Expert Rev. Proteomics. 12 (2015) 637-650. doi:10.1586/14789450.2015.1099435.

[6] F. Martinelli-Boneschi, C. Fenoglio, P. Brambilla, M. Sorosina, G. Giacalone, F. Esposito, M. Serpente, C. Cantoni, E. Ridolfi, M. Rodegher, L. Moiola, B. Colombo, M. De Riz, V. Martinelli, E. Scarpini, G. Comi, D. Galimberti, MicroRNA and mRNA expression profile screening in multiple sclerosis patients to unravel novel pathogenic steps and identify potential biomarkers, Neurosci. Lett. 508 (2012) 4-8. doi:10.1016/j.neulet.2011.11.006.

[7] R. Furlan, M. Rovaris, F. M. Boneschi, M. Khademi, A. Bergami, M. Gironi, M. Deleidi, F. Agosta, D. Franciotta, E. Scarpini, A. Uccelli, M. Zaffaroni, A. Kurne, G. Comi, T. Olsson, M. Filippi, G. Martino, Immunological patterns identifying disease course and evolution in multiple sclerosis patients, J. Neuroimmunol. 165 (2005) 192-200. doi:10.1016/j.jneuroim.2005.04.012.

[8] I. Jelčić, R. Martin, Biomarkers in Multiple Sclerosis, Blue Books Neurol. 35 (2010) 120-146. doi:10.1016/B978-1-4160-6068-0.00006-1.

[9] C. Riveros, D. Mellor, K. S. Gandhi, F. C. Mckay, M. B. Cox, R. Berretta, S. Y. Vaezpour, M. Inostroza-Ponta, S. A. Broadley, R. N. Heard, S. Vucic, G. J. Stewart, D. W. Williams, R. J. Scott, J. Lechner-Scott, D. R. Booth, P. Moscato, A Transcription Factor Map as Revealed by a Genome-Wide Gene Expression Analysis of Whole-Blood mRNA Transcriptome in Multiple Sclerosis, PLOS One. 5 (2010) 4-6. doi:10.1371/journal.pone.0014176.

[10] T. Derfuss, Personalized medicine in multiple sclerosis: Hope or reality?, BMC Med. 10 (2012). doi:10.1186/1741-7015-10-116.

[11] S. E. Baranzini, C. C. a Bernard, J. R. Oksenberg, Modular transcriptional activity characterizes the initiation and progression of autoimmune encephalomyelitis., J. Immunol. 174 (2005) 7412-22. doi:174/11/7412 [pii].

[12] K. Gotovac, S. Hajnšek, M. B. Pašić, N. Pivac, F. Borovečki, Personalized Medicine in Neurodegenerative Diseases: How Far Away?, Mol. Diagn. Ther. 18 (2014) 17-24. doi:10.1007/s40291-013-0058-z.

[13] J. M. Rumble, A. K. Huber, G. Krishnamoorthy, A. Srinivasan, D. A. Giles, X. Zhang, L. Wang, B. M. Segal, Neutrophil-related factors as biomarkers in EAE and MS, J. Exp. Med. 212 (2015) 23-35. doi:10.1084/jem.20141015.

[14] D. Miller, F. Barkhof, X. Montalban, A. Thompson, M. Filippi, Clinically isolated syndromes suggestive of multiple sclerosis, part 2: Non-conventional MRI, recovery processes, and management, Lancet Neurol. 4 (2005) 341-348. doi:10.1016/S1474-4422 (05) 70095-8.

The following references are cited throughout Example 10 according to the number below.

1. Progress in Autoimmune Diseases Research Progress in Autoimmune Diseases Research. (2005). doi:10.1038/80110

2. Hauser, S. L. & Oksenberg, J. R. The Neurobiology of Multiple Sclerosis: Genes, Inflammation, and Neurodegeneration. Neuron 61-76 (2006). doi:10.1016/j.neuron.2006.09.011

3. Wingerchuk, D. M. & Weinshenker, B. G. Disease modifying therapies for relapsing multiple sclerosis. (2016). doi:10.1136/bmj.i3518

4. Metz, I. et al. Pathologic Heterogeneity Persists in Early Active Multiple Sclerosis Lesions. (2014). doi:10.1002/ana.24163

5. Lucchinetti, C. et al. Heterogeneity of multiple sclerosis lesions. *Ann. Neurol.* 47, 707-717 (2000).

6. Breiman, L. Random Forests. *Mach. Learn.* 45, 5-32 (2001).

7. Alter, O., Brown, P. O. & Botstein, D. Singular value decomposition for genome-wide expression data processing and modeling. *Proc. Natl. Acad. Sci.* 97, 10101-10106 (2000).

8. Rao, S. S. et al. Enhanced survival with implantable scaffolds that capture metastatic breast cancer cells in vivo. *Cancer Res.* 76, 5209-5218 (2016).

9. Navegantes, K. C. et al. Immune modulation of some autoimmune diseases: the critical role of macrophages and neutrophils in the innate and adaptive immunity. *J. Transl. Med.* 15, 36 (2017).

10. Yan, Z., Gibson, S. A., Buckley, J. A., Qin, H. & Benveniste, E. N. Role of the JAK/STAT signaling pathway in regulation of innate immunity in neuroinflammatory diseases. *Clin. Immunol.* 189, 4-13 (2018).

11. King, I. L., Dickendesher, T. L. & Segal, B. M. Circulating Ly-6C+ myeloid precursors migrate to the CNS and play a pathogenic role during autoimmune demyelinating disease. *Blood* 113, 3190-3198 (2009).

12. Mayo, L., Quintana, F. J. & Weiner, H. L. The innate immune system in demyelinating disease. *Immunol. Rev.* 170-187 (2012).

13. Ramanathan, M. et al. In vivo gene expression revealed by cDNA arrays: the pattern in relapsing-remitting multiple sclerosis patients compared with normal subjects. 213-219 (2001).

14. Nickles, D. et al. Blood RNA profiling in a large cohort of multiple sclerosis patients and healthy controls. 22, (2013).

15. Comabella, M. & Martin, R. Genomics in multiple sclerosis—Current state and future directions. 187, 1-8 (2007).

16. Ratzer, R. et al. Gene expression analysis of relapsing-remitting, primary progressive and secondary progressive multiple sclerosis. (2013). doi:10.1177/1352458513500553

17. Safari-alighiarloo, N., Rezaei-tavirani, M. & Taghizadeh, M. Network-based analysis of differentially expressed genes in cerebrospinal fluid (CSF) and blood reveals new candidate genes for multiple sclerosis. 1-22 (2016). doi:10.7717/peerj.2775

18. Vanderlugt, C. L. & Miller, S. D. Epitope Spreading in Immune-Mediated Diseases: Implications for Immunotherapy. *Nat. Rev. Immunol.* 2, (2002).

19. Getts, D. R. et al. Microparticles bearing encephalitogenic peptides induce T-cell tolerance and ameliorate experimental autoimmune encephalomyelitis. *Nat. Biotechnol.* 30, 1217-1224 (2012).

20. Hunter, Z. et al. A Biodegradable Nanoparticle Platform for the Induction of Antigen-Specific Immune Tolerance for Treatment of Autoimmune Disease. *ACS Nano* 2148-2160 (2014). doi:10.1021/nn405033r 21. Casey, L. M. et al. Conjugation of Transforming Growth Factor Beta to Antigen-Loaded Poly(lactide-co-glycolide) Nanoparticles Enhances Efficiency of Antigen-Specific Tolerance. *Bioconjug. Chem.* 29, 813-823 (2018).
22. Hachim, D. et al. Effects of Aging upon the Host Response to Implants. *J. Biomed. Mater. Res. Part A* (2017). doi:10.1002/jbm.a.36013
23. Orellano, L. A. A. et al. Upregulation of Foreign Body Response in Obese Mice. *Obesity* 26, 531-539 (2018).
24. Boersema, G. S. A. et al. Monocyte subsets in blood correlate with obesity related response of macrophages to biomaterials in vitro. *Biomaterials* (2016). doi: http://dx.doi.org/10.1016/j.biomaterials.2016.09.009
25. Derfuss, T. Personalized medicine in multiple sclerosis: Hope or reality? *BMC Med.* 10, (2012).
26. Bushnell, G. G. et al. Biomaterial Scaffolds Recruit an Aggressive Population of Metastatic Tumor Cells In Vivo. 1-13 (2019). doi:10.1158/0008-5472.CAN-18-2502
27. Morris, A. H., Mahal, R. S., Udell, J., Wu, M. & Kyriakides, T. R. Multicompartment Drug Release System for Dynamic Modulation of Tissue Responses. *Adv. Healthc. Mater.* 6, (2017).
28. Morris, A. H. et al. Decellularized materials derived from TSP2-KO mice promote enhanced neovascularization and integration in diabetic wounds. *Biomaterials* 169, 61-71 (2018).
29. Miller, S. D., Karpus, W. J. & Davidson, T. S. Experimental Autoimmune Encephalomyelitis in the Mouse. *Curr Protoc Immunol* 1-26 (2007). doi:10.1002/0471142735.im1501s77.Experimental
30. Aguado, B. A. et al. Biomaterial Scaffolds as Pre-metastatic Niche Mimics Systemically Alter the Primary Tumor and Tumor Microenvironment. *Adv. Healthc. Mater.* 1700903, 1-11 (2018).
31. Mccarthy, D. P. et al. An antigen-encapsulating nanoparticle platform for TH1/17 immune tolerance therapy. *Nanomedicine Nanotechnology, Biol. Med.* 13, 191-200 (2017).

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and similar referents in the context of describing the disclosure (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted.

Recitation of ranges of values herein are merely intended to serve as a shorthand method of referring individually to each separate value falling within the range and each endpoint, unless otherwise indicated herein, and each separate value and endpoint is incorporated into the specification as if it were individually recited herein.

All methods described herein can be performed in any suitable order unless otherwise indicated herein or otherwise clearly contradicted by context. The use of any and all examples, or exemplary language (e.g., "such as") provided herein, is intended merely to better illuminate the disclosure and does not pose a limitation on the scope of the disclosure unless otherwise claimed. No language in the specification should be construed as indicating any non-claimed element as essential to the practice of the disclosure.

Preferred embodiments of this disclosure are described herein, including the best mode known to the inventors for carrying out the disclosure. Variations of those preferred embodiments may become apparent to those of ordinary skill in the art upon reading the foregoing description. The inventors expect skilled artisans to employ such variations as appropriate, and the inventors intend for the disclosure to be practiced otherwise than as specifically described herein. Accordingly, this disclosure includes all modifications and equivalents of the subject matter recited in the claims appended hereto as permitted by applicable law. Moreover, any combination of the above-described elements in all possible variations thereof is encompassed by the disclosure unless otherwise indicated herein or otherwise clearly contradicted by context.

---

SEQUENCE LISTING (184 sequences)

SEQ ID NO: 1 - DNA, 2933 bp, Homo sapiens
  ref <308>: DATABASE ACCESSION NUMBER: NCBI / NM_002990.4
  ref <309>: DATABASE ENTRY DATE: 2017-09-10
  ref <313>: RELEVANT RESIDUES IN SEQ ID NO: (1)..(2933)
gcagacacctgggctgagacatacaggacagagcatggatcgcctacagactgcactcctggttgtcctcgtcctccttgctgtggcgcttcaagcaactgaggcaggcccctacggcgccaacatggaagacagcgtctgctgccgtgattacgtccgttaccgtctgcccctgcgcgtggtgaaacacttctactggacctcagactcctgcccgaggcctggcgtggtgttgctaaccttcagggataaggagatctgtgccgatcccagagtgccctgggtgaagatgattctcaataagctgagccaatgaagagcctactctgatgaccgtggccttggctcctccaggaaggctcaggagccctacctccctgccattatagctgctccccgccagaagcctgtgccaactctctgcattccctgatctccatccctgtggctgtcacccttggtcacctccgtgctgtcactgccatctcccccctgacccctctaacccatcctctgcctccctccctgcagtcagagggtcctgttcccatcagcgattcccctgcttaaacccttccatgactccccactgccctaagctgaggtcagtctcccaagcctggcatgtggccctctggatctgggttccatctctgtctccagcctgcccacttcccttcatgaatgttgggttctagctccctgttctccaaacccatactacacatcccacttctgggtctttgcctgggatgttgctgacacccagaaagtcccaccacctgcacatgtgtagccccaccagccctccaaggcattgctcgcccaagcagctggtaattccatttcatgtattagatgtcccctggccctctgtcccctcttaataaccctagtcacagtctccgcagattcttgggatttgggggttttctcccccacctctccactagttggaccaaggtttctagctaagttactctagtctccaagcctctagcatagagcactgcagacaggccctggctcagaatcagagcccagaaagtggctgcagacaaaatcaataaaactaatgtccctcccctctccctgccaaaaggcagttacatatcaatacagagactcaaggtcactagaaatgggccagctgggtcaatgtgaagccccaaatttgcccagattcacctttcttcccccactccctttttttttttttttttgagatggagtttcgctcttgtcacccacgctggagtgcaatggtgtggtcttggcttattgaagcctctgcctcctgggttcaagtgattctcttgcctcagcctcctgagtagctgggattacaggttcctgctaccacgcccagctaatttttgtatttttagtagagacgaggcttcaccatgttggccaggctggtctcgaactcctgtcctcaggtaatccgcccacctcagcctcccaaagtgctgggattacaggcgtgagccacagtgcctggcctcttccctctccccaccccccccccaacttttttttttttttatggcagggtctcactctgtcgcccaggctggagtgcagtggcgtgatctcggctcactacaacctcgacctcctgggttcaagcgattctcccaccccagcctcccaagtagctgggattacaggtgtgtgccactacggctggctaatttttgtatttttagtagagacaggtttcaccatattggccaggctggtcttgaactcctgacctcaagtgatccaccttccttgtgctcccaaagtgctgagattacaggcgtgagctatcacacccagcctccccctttttttcctaataggagactcctgtacctttcttcgttttacctatgtgtcgtgtctgcttacatttccttctcccctcaggctttttttgggtggtcctccaacctccaatacccaggcctggcctcttcagagtaccccccattccactttccctgcctccttccttaaatagctgacaatcaaattcatgctatggtgtgaaagactacctttgacttggtattataagctggagttatatatgtatttgaaaacagagtaaatacttaagaggccaaatagatgaatggaagaattttaggaactgtgagagggggacaaggtggagctttcctggccctgggaggaagctggctgtggtagcgtagcgctctctctctctgtctgtggcaggaggcaaagagtagggtgtaattgagtgaaggaatcctgggtagagaccattctcaggtggttgggccaggctaaagactgggatttgggtctatctatgcctttctggctgatttttgtagagacggggttttgccatgttacccaggctggtctcaaactcctgggctcaagcgatcctcctggctcagcctcccaaagtgctgggattacaggcgtgagtcactgcgcctggcttcctcttcctcttgagaaatattcttttcatacagcaagtatgggacagcagtgtcccaggtaaaggacataaatgttacaagtgtctggtcctttctgagggaggctggtgccgctctgcagggtatttgaacctgtggaattggaggaggccatttcactccctgaacccagcctgacaaatcacagtgagaatgttcaccttataggcttgctgtggggctcaggttgaaagtgtggggagtgacactgcctaggcatccagctcagtgtcatccagggcctgtgtccctcccgaacccagggtcaacctgcctaccacaggcactagaaggacgaatctgcctactgcccatgaacggggccctcaagcgtcctgggatctccttctccctcctgtcctgtccttgcccctcaggactgctggaaaataaatcctttaaaatagtaaaaaaaaaaaaaaa

SEQ ID NO: 2 - protein, 93 aa, Homo sapiens
  ref <308>: DATABASE ACCESSION NUMBER: NCBI / NP_002981.2
  ref <309>: DATABASE ENTRY DATE: 2017-09-10
  ref <313>: RELEVANT RESIDUES IN SEQ ID NO: (1)..(93)
MDRLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 3 - DNA, 1234 bp, Homo sapiens
  ref <308>: DATABASE ACCESSION NUMBER: NCBI / NM_002089.3
  ref <309>: DATABASE ENTRY DATE: 2017-05-07
  ref <313>: RELEVANT RESIDUES IN SEQ ID NO: (1)..(1234)
gagctccgggaatttccctggcccgggactccgggctttccagccccaaccatgcataaaaggggttcgccgttctcggagagccacagagcccgggccacaggcagctccttgccagctctcctcctcgcacagccgctcgaaccgcctgctgagccccatggcccgcgccacgctctccgccgcccccagcaatccccggctcctgcgggtggcgctgctgctcctgctcctggtggccgccagccggcgcgcagcaggagcgcccctggccactgaactgcgctgccagtgcttgcagaccctgcagggaattcacctcaagaacatccaaagtgtgaaggtgaagtcccccggaccccactgcgcccaaaccgaagtcatagccacactcaagaatgggcagaaagcttgtctcaaccccgcatcgcccatggttaagaaaatcatcgaaaagatgctgaaaaatggcaaatccaactgaccagaaggaaggaggaagcttattggtggctgttcctgaaggaggccctgcccttacaggaacagaagaggaaagagagacacagctgcagaggccacctggattgcgcctaatgtgtttgagcatcacttaggagaagtcttctatttatttatttatttatttatttgtttgttttagaagattctatgttaatattttatgtgtaaaataaggttatgattgaatctacttgcacactctcccattatatttattgtttattttaggtcaaacccaagttagttcaatcctgattcatatttaatttgaagatagaaggtttgcagatattctctagtcatttgttaatatttcttcgtgatgacatatcacatgtcagccactgtgatagaggctgaggaatccaagaaaatggccagtgagatcaatgtgacggcagggaaatgtatgtgtgtctattttgtaactgtaaagatgaatgtcagttgttatttattgaaatgatttcacagtgtgtggtcaacatttctcatgttgaagctttaagaactaaaatgttctaaatatcccttggacattttatgtctttcttgtaaggcatactgccttgtttaatgttaattatgcagtgtttccctctgtgttagagcagagaggtttcgatatttattgatgttttcacaaagaacaggaaaataaaatatttaaaaatataaaaaaaaaaaaaaaaaaaaaaaaaaaaaaaaa

SEQ ID NO: 4 - protein, 107 aa, Homo sapiens
  ref <308>: DATABASE ACCESSION NUMBER: NCBI / NP_002080.1
  ref <309>: DATABASE ENTRY DATE: 2017-05-07
  ref <313>: RELEVANT RESIDUES IN SEQ ID NO: (1)..(107)
MARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 5 - DNA, 2157 bp, Homo sapiens
  ref <308>: DATABASE ACCESSION NUMBER: NCBI / NM_001301714.1
  ref <309>: DATABASE ENTRY DATE: 2017-09-11
  ref <313>: RELEVANT RESIDUES IN SEQ ID NO: (1)..(2157)
cacttcctccccagacaggggtagtgcgaggccgggcacagccttcctgtgtggttttaccgcccagagagcgtcatggacctgggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaaaaaaaaaaaaaaaaaaaaaaaa

SEQ ID NO: 6 - protein, 315 aa, Homo sapiens
  ref <308>: DATABASE ACCESSION NUMBER: NCBI / NP_001288643.1
  ref <309>: DATABASE ENTRY DATE: 2017-09-11
  ref <313>: RELEVANT RESIDUES IN SEQ ID NO: (1)..(315)
MYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 7 - DNA, 2457 bp, Homo sapiens
  ref <308>: DATABASE ACCESSION NUMBER: NCBI / NM_001301716.1
  ref <309>: DATABASE ENTRY DATE: 2017-09-11
  ref <313>: RELEVANT RESIDUES IN SEQ ID NO: (1)..(2457)
ctctagatgagtcagtggagggcgggtggagcgttgaaccgtgaagagtgtggttgggcgtaaacgtggacttaaactcaggagctaaggggtaattcagtgaaaaaggggaatgagcggtggggagctctgttgcaacagggtccaatcgcagcaggactacaaatgcccgagcgcaggctgggaacgaggggacagcggctgcctgtccccagaatagaaaatgcagctaggaagccctctttgagtggacagcggaggactggactgccaggccaagcatcaggggcttcatcctcagggccggttagagcccctgaggatttaggaggaagggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaaaaaaaaaaaaaaaaaaaaaaaa

SEQ ID NO: 8 - protein, 372 aa, Homo sapiens
  ref <308>: DATABASE ACCESSION NUMBER: NCBI / NP_001288645.1
  ref <309>: DATABASE ENTRY DATE: 2017-09-11
  ref <313>: RELEVANT RESIDUES IN SEQ ID NO: (1)..(372)
MKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 9 - DNA, 2213 bp, Homo sapiens
  ref <308>: DATABASE ACCESSION NUMBER: NCBI / NM_001301717.1
  ref <309>: DATABASE ENTRY DATE: 2017-09-11
  ref <313>: RELEVANT RESIDUES IN SEQ ID NO: (1)..(2213)
ctctagatgagtcagtggagggcgggtggagcgttgaaccgtgaagagtgtggttgggcgtaaacgtggacttaaactcaggagctaagggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaaaaaaaaaaaaaaaaaaaaaaaa

SEQ ID NO: 10 - protein, 372 aa, Homo sapiens; identical to SEQ ID NO: 8
  ref <308>: DATABASE ACCESSION NUMBER: NCBI / NP_001288646.1
  ref <309>: DATABASE ENTRY DATE: 2017-09-11
  ref <313>: RELEVANT RESIDUES IN SEQ ID NO: (1)..(372)

SEQ ID NO: 11 - DNA, 2303 bp, Homo sapiens
  ref <308>: DATABASE ACCESSION NUMBER: NCBI / NM_001301718.1
  ref <309>: DATABASE ENTRY DATE: 2017-09-11
  ref <313>: RELEVANT RESIDUES IN SEQ ID NO: (1)..(2303)
aggagaaggtgccttaaacaggttcccacgcatttcctggcgctattgagcttggagctgccaagggcctgccttcacttgtggcatcgcagttactgactctccagtgggccaggccctacctagctgggacctgagggtcaggatacgggaagagggctactgccgccctgacttgtagggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaaaaaaaaaaaaaaaaaaaaaaaa

SEQ ID NO: 12 - protein, 372 aa, Homo sapiens; identical to SEQ ID NO: 8
  ref <308>: DATABASE ACCESSION NUMBER: NCBI / NP_001288647.1
  ref <309>: DATABASE ENTRY DATE: 2017-09-11
  ref <313>: RELEVANT RESIDUES IN SEQ ID NO: (1)..(372)

SEQ ID NO: 13 - DNA, 2207 bp, Homo sapiens
  ref <308>: DATABASE ACCESSION NUMBER: NCBI / NM_001838.3
  ref <309>: DATABASE ENTRY DATE: 2017-09-11
  ref <313>: RELEVANT RESIDUES IN SEQ ID NO: (1)..(2207)
cacttcctccccagacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaaaaaaaaaaaaaaaaaaaaaaaa

SEQ ID NO: 14 - protein, 378 aa, Homo sapiens
  ref <308>: DATABASE ACCESSION NUMBER: NCBI / NP_001829.1
  ref <309>: DATABASE ENTRY DATE: 2017-09-11
  ref <313>: RELEVANT RESIDUES IN SEQ ID NO: (1)..(378)
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 15 - DNA, 1602 bp, Homo sapiens
  ref <308>: DATABASE ACCESSION NUMBER: NCBI / NM_000759.3
  ref <309>: DATABASE ENTRY DATE: 2017-09-10
  ref <313>: RELEVANT RESIDUES IN SEQ ID NO: (1)..(1602)
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgagtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaa

SEQ ID NO: 16 - protein, 207 aa, Homo sapiens
  ref <308>: DATABASE ACCESSION NUMBER: NCBI / NP_000750.1
  ref <309>: DATABASE ENTRY DATE: 2017-09-10
  ref <313>: RELEVANT RESIDUES IN SEQ ID NO: (1)..(207)
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 17 - DNA, 1485 bp, Homo sapiens
  ref <308>: DATABASE ACCESSION NUMBER: NCBI / NM_001178147.1
  ref <309>: DATABASE ENTRY DATE: 2017-09-10
  ref <313>: RELEVANT RESIDUES IN SEQ ID NO: (1)..(1485)
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaa

SEQ ID NO: 18 - protein, 168 aa, Homo sapiens
  ref <308>: DATABASE ACCESSION NUMBER: NCBI / NP_001171618.1
  ref <309>: DATABASE ENTRY DATE: 2017-09-10
  ref <313>: RELEVANT RESIDUES IN SEQ ID NO: (1)..(168)
MAGPATQSPMKLMALQLLLWHSALWTVQEATPLGPASSLPQSFLLKCLEQVRKIQGDGAALQEKLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 19 - DNA, 1593 bp, Homo sapiens
  ref <308>: DATABASE ACCESSION NUMBER: NCBI / NM_172219.2
  ref <309>: DATABASE ENTRY DATE: 2017-09-10
  ref <313>: RELEVANT RESIDUES IN SEQ ID NO: (1)..(1593)
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaa

SEQ ID NO: 20 - protein, 204 aa, Homo sapiens
  ref <308>: DATABASE ACCESSION NUMBER: NCBI / NP_757373.1
  ref <309>: DATABASE ENTRY DATE: 2017-09-10
  ref <313>: RELEVANT RESIDUES IN SEQ ID NO: (1)..(204)
MAGPATQSPMKLMALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 21 - DNA, 1494 bp, Homo sapiens
  ref <308>: DATABASE ACCESSION NUMBER: NCBI / NM_172220.2
  ref <309>: DATABASE ENTRY DATE: 2017-09-10
  ref <313>: RELEVANT RESIDUES IN SEQ ID NO: (1)..(1494)
agtcgtggccccaggtaatttcctcccaggcctccatggggttatgtataaaggcccccctagagctgggccccaaaacagcccggagcctgcagcccagccccacccagacccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctggtgagtgaggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccaaaaaaaaaaa

SEQ ID NO: 22 - protein, 171 aa, Homo sapiens
  ref <308>: DATABASE ACCESSION NUMBER: NCBI / NP_757374.2
  ref <309>: DATABASE ENTRY DATE: 2017-09-10
  ref <313>: RELEVANT RESIDUES IN SEQ ID NO: (1)..(171)
MAGPATQSPMKLMALQLLLWHSALWTVQEATPLGPASSLPQSFLLKCLEQVRKIQGDGAALQEKLVSEAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 23 - DNA, 1262 bp, Homo sapiens
  ref <308>: DATABASE ACCESSION NUMBER: NCBI / NM_005448.2
  ref <309>: DATABASE ENTRY DATE: 2017-10-02
  ref <313>: RELEVANT RESIDUES IN SEQ ID NO: (1)..(1262)
tcccttgggcttgtgttggggcctgttgttgaacactaagcctttcaagatggtcctcctcagtattcttagaattctttttctttgtgaactcgtgcttttcatggaacacagggcccaaatggcagaaggagggcagtcctctattgcccttctggctgaggcccctactttgcccctgattgaggagctgctagaagaatcccctggcgaacagccaaggaagccccggctcctagggcattcactgcggtacatgctggagttgtaccggcgttcagctgactcgcatgggcaccctagagagaaccgcaccattggggccaccatggtgaggctggtgaagcccttgaccaatgtggcaaggcctcacagaggtacctggcatatacagatcctgggctttcctctcagaccaaaccgaggactataccaactagttagagccactgtggtttaccgccatcatctccaactaactcgcttcaatctctcctgccatgtggagccctgggtgcagaaaaacccaaccaaccacttcccttcctcagaaggagattcctcaaaaccttccctgatgtctaacgcttggaaagagatggatatcacacaacttgttcagcaaaggttctggaataacaagggacacaggatcctacgactccgttttatgtgtcagcagcaaaaagatagtggtggtcttgagctctggcatggcacttcatccttggacattgccttcttgttactctatttcaatgatactcataaaagcattcggaaggctaaatttcttcccaggggcatggaggagttcatggaaagggaatctcttctccggagaacccgacaagcagatggtatctcagctgaggttactgcctcttcctcaaaacatagcgggcctgaaaataaccagtgttccctccaccctttccaaatcagcttccgccagctgggttgggatcactggatcattgctccccctttctacaccccaaactactgtaaaggaacttgtctccgagtactacgcgatggtctcaattcccccaatcacgccattattcagaaccttatcaatcagttggtggaccagagtgtcccccggccctcctgtgtcccgtataagtatgttccaattagtgtccttatgattgaggcaaatgggagtattttgtacaaggagtatgagggtatgattgctgagtcttgtacatgcagatgacagcaacagtacggctagatcaggtttcccagga

SEQ ID NO: 24 - protein, 392 aa, Homo sapiens
  ref <308>: DATABASE ACCESSION NUMBER: NCBI / NP_005439.2
  ref <309>: DATABASE ENTRY DATE: 2017-10-02
  ref <313>: RELEVANT RESIDUES IN SEQ ID NO: (1)..(392)
MVLLSILRILFLCELVLFMEHRAQMAEGGQSSIALLAEAPTLPLIEELLEESPGEQPRKPRLLGHSLRYMLELYRRSADSHGHPRENRTIGATMVRLVKPLTNVARPHRGTWHIQILGFPLRPNRGLYQLVRATVVYRHHLQLTRFNLSCHVEPWVQKNPTNHFPSSEGDSSKPSLMSNAWKEMDITQLVQQRFWNNKGHRILRLRFMCQQQKDSGGLELWHGTSSLDIAFLLLYFNDTHKSIRKAKFLPRGMEEFMERESLLRRTRQADGISAEVTASSSKHSGPENNQCSLHPFQISFRQLGWDHWIIAPPFYTPNYCKGTCLRVLRDGLNSPNHAIIQNLINQLVDQSVPRPSCVPYKYVPISVLMIEANGSILYKEYEGMIAESCTCR

SEQ ID NO: 25 - DNA, 1049 bp, Homo sapiens
  ref <308>: DATABASE ACCESSION NUMBER: NCBI / NM_016584.2
  ref <309>: DATABASE ENTRY DATE: 2017-09-25
  ref <313>: RELEVANT RESIDUES IN SEQ ID NO: (1)..(1049)
aaaacaacaggaagcagcttacaaactcggtgaacaactgagggaaccaaaccagagacgcgctgaacagagagaatcaggctcaaagcaagtggaagtgggcagagattccaccaggactggtgcaaggcgcagagccagccagatttgagaagaaggcaaaaagatgctggggagcagagctgtaatgctgctgttgctgctgccctggacagctcagggcagagctgtgcctgggggcagcagccctgcctggactcagtgccagcagctttcacagaagctctgcacactggcctggagtgcacatccactagtgggacacatggatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtgggccagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccctaaaggcagcagctcaaggatggcactcagatctccatggcccagcaaggccaagataaatctaccaccccaggcacctgtgagccaacaggttaattagtccattaattttagtgggacctgcatatgttgaaaattaccaatactgactgacatgtgatgctgacctatgataaggttgagtatttattagatgggaagggaaatttggggattatttatcctcctggggacagtttggggaggattatttattgtatttatattgaattatgtacttttttcaataaagtcttatttttgtggctaaaaaaaa

SEQ ID NO: 26 - protein, 189 aa, Homo sapiens
  ref <308>: DATABASE ACCESSION NUMBER: NCBI / NP_057668.1
  ref <309>: DATABASE ENTRY DATE: 2017-09-25
  ref <313>: RELEVANT RESIDUES IN SEQ ID NO: (1)..(189)
MLGSRAVMLLLLLPWTAQGRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 27 - DNA, 586 bp, Homo sapiens
  ref <308>: DATABASE ACCESSION NUMBER: NCBI / NM_002965.3
  ref <309>: DATABASE ENTRY DATE: 2017-10-09
  ref <313>: RELEVANT RESIDUES IN SEQ ID NO: (1)..(586)
aaacactctgtgtggctcctcggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccacggccacagtcatggtggccacggccacagccactaatcaggaggccaggccaccctgcctctacccaaccagggccccggggcctgttatgtcaaactgtcttggctgtggggctaggggctggggccaaataaagtctcttcctccaagtcaaaaaaaaaa

SEQ ID NO: 28 - protein, 114 aa, Homo sapiens
  ref <308>: DATABASE ACCESSION NUMBER: NCBI / NP_002956.1
  ref <309>: DATABASE ENTRY DATE: 2017-10-09
  ref <313>: RELEVANT RESIDUES IN SEQ ID NO: (1)..(114)
MTCKMSQLERNIETIINTFHQYSVKLGHPDTLNQGEFKELVRKDLQNFLKKENKNEKVIEHIMEDLDTNADKQLSFEEFIMLMARLTWASHEKMHEGDEGPGHHHKPGLGEGTP

SEQ ID NO: 29 - DNA, 1539 bp, Homo sapiens
  ref <308>: DATABASE ACCESSION NUMBER: NCBI / NM_009892.3
  ref <309>: DATABASE ENTRY DATE: 2017-10-03
  ref <313>: RELEVANT RESIDUES IN SEQ ID NO: (1)..(1539)
aaaaagccagcagaagctctccagaagcaatcctgaagacaccatggccaagctcattcttgtcacaggtctggcaattcttctgaacgtacagctgggatcttcctaccagctgatgtgctactataccagttgggctaaggacaggccaatagaagggagtttcaaacctggtaatattgacccctgcctgtgtactcacctgatctatgcctttgctggaatgcagaataatgagatcacttacacacatgagcaagacttgcgtgactatgaagcattgaatggtctgaaagacaagaacactgagctaaaaactctcctggccattggaggatggaagtttggacctgccccgttcagtgccatggtctctactcctcagaaccgtcagatattcattcagtcagttatcagattccttcgtcaatataactttgatggcctcaacctggactggcagtaccctgggtctcgaggaagccctcctaaggacaaacatctcttcagtgttctggtgaaggaaatgcgtaaagcttttgaggaagaatctgtggagaaagacattccaaggctgctactcacttccacaggagcaggaatcattgacgtaatcaagtctgggtacaagatccctgaactgtctcagtctcttgactatattcaggtcatgacatatgatctccatgatcctaaggatggctacactggagaaaatagtcccctctataaatctccatatgacattggaaagagtgctgatctcaatgtggattcaatcatttcctactggaaggaccatggagcagcttctgagaagctcattgtgggatttccagcatatgggcatacctttatcctgagtgacccttctaagactggaattggtgcccctacaattagtactggcccaccaggaaagtacacagatgaatcaggactcctggcttactatgaggtttgtacatttctgaatgaaggagccactgaggtctgggatgccccccaggaagtaccctatgcctatcagggtaatgagtgggttggttatgacaatgtcaggagcttcaagttgaaggctcagtggctcaaggacaacaatttaggaggtgccgtggtctggcccctggacatggatgacttcagtggttctttctgtcaccagagacatttccctctgacatctactttaaagggagatctcaatatacacagtgcaagttgcaagggcccttattgagaggagctttacacaatgatttgtccttgaaactctcagaataagatcaagttcaacggtttttccacagtgcattctgcatcatgcttccatggagaataatagaaataagtcatgaactttcctaaattgaatcccagagtagtactaagatggatgtcttgtctgctgtaccagctgggaagaaacaaaaaatgctcttcatctgtcagctttggctaagctctgaacatcttttgcttcctgtaaaaccaccatgcttgtttcttgctctcacaataaattccacattcatagca

SEQ ID NO: 30 - protein, 398 aa, Homo sapiens
  ref <308>: DATABASE ACCESSION NUMBER: NCBI / NP_034022.2
  ref <309>: DATABASE ENTRY DATE: 2017-10-03
  ref <313>: RELEVANT RESIDUES IN SEQ ID NO: (1)..(398)
MAKLILVTGLAILLNVQLGSSYQLMCYYTSWAKDRPIEGSFKPGNIDPCLCTHLIYAFAGMQNNEITYTHEQDLRDYEALNGLKDKNTELKTLLAIGGWKFGPAPFSAMVSTPQNRQIFIQSVIRFLRQYNFDGLNLDWQYPGSRGSPPKDKHLFSVLVKEMRKAFEEESVEKDIPRLLLTSTGAGIIDVIKSGYKIPELSQSLDYIQVMTYDLHDPKDGYTGENSPLYKSPYDIGKSADLNVDSIISYWKDHGAASEKLIVGFPAYGHTFILSDPSKTGIGAPTISTGPPGKYTDESGLLAYYEVCTFLNEGATEVWDAPQEVPYAYQGNEWVGYDNVRSFKLKAQWLKDNNLGGAVVWPLDMDDFSGSFCHQRHFPLTSTLKGDLNIHSASCKGPY

SEQ ID NO: 31 - DNA, 549 bp, Homo sapiens
  ref <308>: DATABASE ACCESSION NUMBER: NCBI / NM_001319196.1
  ref <309>: DATABASE ENTRY DATE: 2017-09-25
  ref <313>: RELEVANT RESIDUES IN SEQ ID NO: (1)..(549)
gagaaaccagagactgtagcaactctggcagggagaagctgtctctgatggcctgaagctgtgggcagctggccaagcctaaccgctataaaaaggagctgcctctcagccctgcatgtctcttgtcagctgtctttcagaagacctgaaggttctgtttttcaggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaa

SEQ ID NO: 32 - protein, 117 aa, Homo sapiens
  ref <308>: DATABASE ACCESSION NUMBER: NCBI / NP_001306125.1
  ref <309>: DATABASE ENTRY DATE: 2017-09-25
  ref <313>: RELEVANT RESIDUES IN SEQ ID NO: (1)..(117)
MSLVSCLSEDLKVLFFRWGKSVGIMLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 33 - DNA, 546 bp, Homo sapiens
  ref <308>: DATABASE ACCESSION NUMBER: NCBI / NM_001319197.1
  ref <309>: DATABASE ENTRY DATE: 2017-09-25
  ref <313>: RELEVANT RESIDUES IN SEQ ID NO: (1)..(546)
gagaaaccagagactgtagcaactctggcagggagaagctgtctctgatggcctgaagctgtgggcagctggccaagcctaaccgctataaaaaggagctgcctctcagccctgcatgtctcttgtcagctgtctttcagaagacctggttctgtttttcaggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaa

SEQ ID NO: 34 - protein, 116 aa, Homo sapiens
  ref <308>: DATABASE ACCESSION NUMBER: NCBI / NP_001306126.1
  ref <309>: DATABASE ENTRY DATE: 2017-09-25
  ref <313>: RELEVANT RESIDUES IN SEQ ID NO: (1)..(116)
MSLVSCLSEDLVLFFRWGKSVGIMLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 35 - DNA, 450 bp, Homo sapiens
  ref <308>: DATABASE ACCESSION NUMBER: NCBI / NM_001319198.1
  ref <309>: DATABASE ENTRY DATE: 2017-09-25
  ref <313>: RELEVANT RESIDUES IN SEQ ID NO: (1)..(450)
tgttttgatatcagaatttctggggaacatttggatttccagaatctctttcacatcagctgtaatgtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaa

SEQ ID NO: 36 - protein, 101 aa, Homo sapiens
  ref <308>: DATABASE ACCESSION NUMBER: NCBI / NP_001306127.1
  ref <309>: DATABASE ENTRY DATE: 2017-09-25
  ref <313>: RELEVANT RESIDUES IN SEQ ID NO: (1)..(101)
MWGKSVGIMLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 37 - DNA, 504 bp, Homo sapiens
  ref <308>: DATABASE ACCESSION NUMBER: NCBI / NM_001319201.1
  ref <309>: DATABASE ENTRY DATE: 2017-09-25
  ref <313>: RELEVANT RESIDUES IN SEQ ID NO: (1)..(504)
gagcagccttcctgagagaggagagagaaagctcagggaggtctggagcaaagatactcctggaggtggggagtgaggcagggataaggaaggagagtatcctccagcaccttccagtgggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaa

SEQ ID NO: 38 - protein, 93 aa, Homo sapiens
  ref <308>: DATABASE ACCESSION NUMBER: NCBI / NP_001306130.1
  ref <309>: DATABASE ENTRY DATE: 2017-09-25
  ref <313>: RELEVANT RESIDUES IN SEQ ID NO: (1)..(93)
MLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 39 - DNA, 532 bp, Homo sapiens
  ref <308>: DATABASE ACCESSION NUMBER: NCBI / NM_002964.4
  ref <309>: DATABASE ENTRY DATE: 2017-09-25
  ref <313>: RELEVANT RESIDUES IN SEQ ID NO: (1)..(532)
gagaaaccagagactgtagcaactctggcagggagaagctgtctctgatggcctgaagctgtgggcagctggccaagcctaaccgctataaaaaggagctgcctctcagccctgcatgtctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaatacctcaaaaaaaaaa

SEQ ID NO: 40 - protein, 93 aa, Homo sapiens; identical to SEQ ID NO: 38
  ref <308>: DATABASE ACCESSION NUMBER: NCBI / NP_002955.2
  ref <309>: DATABASE ENTRY DATE: 2017-09-25
  ref <313>: RELEVANT RESIDUES IN SEQ ID NO: (1)..(93)

SEQ ID NO: 41 - DNA, 2537 bp, Homo sapiens
  ref <308>: DATABASE ACCESSION NUMBER: NCBI / NM_001199149.1
  ref <309>: DATABASE ENTRY DATE: 2017-10-09
  ref <313>: RELEVANT RESIDUES IN SEQ ID NO: (1)..(2537)
gtccaggattctggctcagagttgcaccactgggttttatattcacttggatctttagttgttttggcgcctactgaggtctgaagtttgaatcctgcagtcaattgggatggtggcttgtaccccaaagtgccattgcaacccttgtccttcctgaggaaagggtggcagttgccctgtggaattcctgccctgctccccgtgggtgtccaggctgacagaagttgggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaaaaaaaaaaaaaaaaaaaaaaaaaaa

SEQ ID NO: 42 - protein, 666 aa, Homo sapiens
  ref <308>: DATABASE ACCESSION NUMBER: NCBI / NP_001186078.1
  ref <309>: DATABASE ENTRY DATE: 2017-10-09
  ref <313>: RELEVANT RESIDUES IN SEQ ID NO: (1)..(666)
MRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 43 - DNA, 2642 bp, Homo sapiens
  ref <308>: DATABASE ACCESSION NUMBER: NCBI / NM_001321121.1
  ref <309>: DATABASE ENTRY DATE: 2017-10-09
  ref <313>: RELEVANT RESIDUES IN SEQ ID NO: (1)..(2642)
gactcctaggggcttgcagactagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggggcaaagccctgaataaaggggcgcagggcaggcgcaagtggcagagccttcgtttgccaagtcgcctccagaccgcagacatgaaacttgtcttcctcgtcctgctgttcctcggggccctcggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaaaaaaaaaaaaaaaaaaaaaaaaaaa

SEQ ID NO: 44 - protein, 708 aa, Homo sapiens
  ref <308>: DATABASE ACCESSION NUMBER: NCBI / NP_001308050.1
  ref <309>: DATABASE ENTRY DATE: 2017-10-09
  ref <313>: RELEVANT RESIDUES IN SEQ ID NO: (1)..(708)
MKLVFLVLLFLGALGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 45 - DNA, 2881 bp, Homo sapiens
  ref <308>: DATABASE ACCESSION NUMBER: NCBI / NM_001321122.1
  ref <309>: DATABASE ENTRY DATE: 2017-10-09
  ref <313>: RELEVANT RESIDUES IN SEQ ID NO: (1)..(2881)
acgtggccttcacagctggcctgagtgagcacagcgggcactgaggggaacaaagcgtgggggccctccagcagcccttatcatcacctgccagccacctgcctcaggctgggcaggctgcaccctgggctttctgctattggcttcccagatccctggaactccagctggggccctgggctgtggtctgacttgatccagaatttaatgagtagaaggaatggaagaaggctcattcccccagccctggacacagacagcagacacagaggcctccagcacagtgaagcctgtggagcagtcccctccagaatgcaaccttgtaggagggcagcaccatgggccagcaactcagggtgatcagcaaataaatgatcaatactaagacaccaaggccctaagaagtcactggatggggtcccgggtggatttctagctctactgtccactggctgtgagaccatgaacagggtgcattgcccaagtccactcagctggaaacaggctctttgagatctgacccaactcctggcacgttggagatgtcccatagaccagtgttgaatgaatgggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaaaaaaaaaaaaaaaaaaaaaaaaaaa

SEQ ID NO: 46 - protein, 697 aa, Homo sapiens
  ref <308>: DATABASE ACCESSION NUMBER: NCBI / NP_001308051.1
  ref <309>: DATABASE ENTRY DATE: 2017-10-09
  ref <313>: RELEVANT RESIDUES IN SEQ ID NO: (1)..(697)
MGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 47 - DNA, 2648 bp, Homo sapiens
  ref <308>: DATABASE ACCESSION NUMBER: NCBI / NM_002343.5
  ref <309>: DATABASE ENTRY DATE: 2017-10-09
  ref <313>: RELEVANT RESIDUES IN SEQ ID NO: (1)..(2648)
gactcctaggggcttgcagactagtgggagagaaagaacatcgcagcagccaggcagaaccaggacaggtgaggtgcaggctggctttcctctcgcagcgcggtgtggagtcctgtcctgcctcagggcttttcggagcctggatcctcaaggaacaagtagacctggccgcggggagtggggagggaaggggtgtctattgggcaacagggcggggcaaagccctgaataaaggggcgcagggcaggcgcaagtggcagagccttcgtttgccaagtcgcctccagaccgcagacatgaaacttgtcttcctcgtcctgctgttcctcggggccctcggactgtgtctggctggccgtaggaggagtgttcagtggtgcgccgtatcccaacccgaggccacaaaatgcttccaatggcaaaggaatatgagaaaagtgcgtggccctcctgtcagctgcataaagagagactcccccatccagtgtatccaggccattgcggaaaacagggccgatgctgtgacccttgatggtggtttcatatacgaggcaggcctggccccctacaaactgcgacctgtagcggcggaagtctacgggaccgaaagacagccacgaactcactattatgccgtggctgtggtgaagaagggcggcagctttcagctgaacgaactgcaaggtctgaagtcctgccacacaggccttcgcaggaccgctggatggaatgtccctatagggacacttcgtccattcttgaattggacgggtccacctgagcccattgaggcagctgtggccaggttcttctcagccagctgtgttcccggtgcagataaaggacagttccccaacctgtgtcgcctgtgtgcggggacaggggaaaacaaatgtgccttctcctcccaggaaccgtacttcagctactctggtgccttcaagtgtctgagagacggggctggagacgtggcttttatcagagagagcacagtgtttgaggacctgtcagacgaggctgaaagggacgagtatgagttactctgcccagacaacactcggaagccagtggacaagttcaaagactgccatctggcccgggtcccttctcatgccgttgtggcacgaagtgtgaatggcaaggaggatgccatctggaatcttctccgccaggcacaggaaaagtttggaaaggacaagtcaccgaaattccagctctttggctcccctagtgggcagaaagatctgctgttcaaggactctgccattgggttttcgagggtgcccccgaggatagattctgggctgtaccttggctccggctacttcactgccatccagaacttgaggaaaagtgaggaggaagtggctgcccggcgtgcgcgggtcgtgtggtgtgcggtgggcgagcaggagctgcgcaagtgtaaccagtggagtggcttgagcgaaggcagcgtgacctgctcctcggcctccaccacagaggactgcatcgccctggtgctgaaaggagaagctgatgccatgagtttggatggaggatatgtgtacactgcaggcaaatgtggtttggtgcctgtcctggcagagaactacaaatcccaacaaagcagtgaccctgatcctaactgtgtggatagacctgtggaaggatatcttgctgtggcggtggttaggagatcagacactagccttacctggaactctgtgaaaggcaagaagtcctgccacaccgccgtggacaggactgcaggctggaatatccccatgggcctgctcttcaaccagacgggctcctgcaaatttgatgaatatttcagtcaaagctgtgcccctgggtctgacccgagatctaatctctgtgctctgtgtattggcgacgagcagggtgagaataagtgcgtgcccaacagcaacgagagatactacggctacactggggctttccggtgcctggctgagaatgctggagacgttgcatttgtgaaagatgtcactgtcttgcagaacactgatggaaataacaatgaggcatgggctaaggatttgaagctggcagactttgcgctgctgtgcctcgatggcaaacggaagcctgtgactgaggctagaagctgccatcttgccatggccccgaatcatgccgtggtgtctcggatggataaggtggaacgcctgaaacaggtgttgctccaccaacaggctaaatttgggagaaatggatctgactgcccggacaagttttgcttattccagtctgaaaccaaaaaccttctgttcaatgacaacactgagtgtctggccagactccatggcaaaacaacatatgaaaaatatttgggaccacagtatgtcgcaggcattactaatctgaaaaagtgctcaacctcccccctcctggaagcctgtgaattcctcaggaagtaaaaccgaagaagatggcccagctccccaagaaagcctcagccattcactgcccccagctcttctccccaggtgtgttggggccttggcctcccctgctgaaggtggggattgcccatccatctgcttacaattccctgctgtcgtcttagcaagaagtaaaatgagaaattttgttgatattctctccttaaaaaaaaaaaaaaaaaaaaaaaaaaaaaa

SEQ ID NO: 48 - protein, 710 aa, Homo sapiens
  ref <308>: DATABASE ACCESSION NUMBER: NCBI / NP_002334.2
  ref <309>: DATABASE ENTRY DATE: 2017-10-09
  ref <313>: RELEVANT RESIDUES IN SEQ ID NO: (1)..(710)
MKLVFLVLLFLGALGLCLAGRRRSVQWCAVSQPEATKCFQWQRNMRKVRGPPVSCIKRDSPIQCIQAIAENRADAVTLDGGFIYEAGLAPYKLRPVAAEVYGTERQPRTHYYAVAVVKKGGSFQLNELQGLKSCHTGLRRTAGWNVPIGTLRPFLNWTGPPEPIEAAVARFFSASCVPGADKGQFPNLCRLCAGTGENKCAFSSQEPYFSYSGAFKCLRDGAGDVAFIRESTVFEDLSDEAERDEYELLCPDNTRKPVDKFKDCHLARVPSHAVVARSVNGKEDAIWNLLRQAQEKFGKDKSPKFQLFGSPSGQKDLLFKDSAIGFSRVPPRIDSGLYLGSGYFTAIQNLRKSEEEVAARRARVVWCAVGEQELRKCNQWSGLSEGSVTCSSASTTEDCIALVLKGEADAMSLDGGYVYTAGKCGLVPVLAENYKSQQSSDPDPNCVDRPVEGYLAVAVVRRSDTSLTWNSVKGKKSCHTAVDRTAGWNIPMGLLFNQTGSCKFDEYFSQSCAPGSDPRSNLCALCIGDEQGENKCVPNSNERYYGYTGAFRCLAENAGDVAFVKDVTVLQNTDGNNNEAWAKDLKLADFALLCLDGKRKPVTEARSCHLAMAPNHAVVSRMDKVERLKQVLLHQQAKFGRNGSDCPDKFCLFQSETKNLLFNDNTECLARLHGKTTYEKYLGPQYVAGITNLKKCSTSPLLEACEFLRK

SEQ ID NO: 49 - DNA, 1020 bp, Homo sapiens
  ref <308>: DATABASE ACCESSION NUMBER: NCBI / NM_001972.3
  ref <309>: DATABASE ENTRY DATE: 2017-10-03
  ref <313>: RELEVANT RESIDUES IN SEQ ID NO: (1)..(1020)
gggagaggaagtggagggcgctggccggccgtggggcaatgcaacggcctcccagcacagggctataagaggagccgggcgggcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaaaaaaaaaaaaaaaa

SEQ ID NO: 50 - protein, 267 aa, Homo sapiens
  ref <308>: DATABASE ACCESSION NUMBER: NCBI / NP_001963.1
  ref <309>: DATABASE ENTRY DATE: 2017-10-09
  ref <313>: RELEVANT RESIDUES IN SEQ ID NO: (1)..(267)
MTLGRRLACLFLACVLPALLLGGTALASEIVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 51 - DNA, 758 bp, Homo sapiens
  ref <308>: DATABASE ACCESSION NUMBER: NCBI / NM_004345.4
  ref <309>: DATABASE ENTRY DATE: 2017-08-21
  ref <313>: RELEVANT RESIDUES IN SEQ ID NO: (1)..(758)
gtcctgtgaagcaatagccaggggctaaagcaaaccccagcccacaccctggcaggcagccagggatgggtggatcaggaaggctcctggttgggcttttgcatcaggctcaggctgggcataaaggaggctcctgtgggctagagggaggcagacatggggaccatgaagacccaaagggatggccactccctggggcggtggtcactggtgctcctgctgctgggcctggtgatgcctctggccatcattgcccaggtcctcagctacaaggaagctgtgcttcgtgctatagatggcatcaaccagcggtcctcggatgctaacctctaccgcctcctggacctggaccccaggcccacgatggatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctagtgtgtgccctaccctggctcaggcttctgggctctgagaaataaactatgagagcaatttcctcaggaaaaaaaaaaaaa

SEQ ID NO: 52 - protein, 173 aa, Homo sapiens
  ref <308>: DATABASE ACCESSION NUMBER: NCBI / NP_004336.3
  ref <309>: DATABASE ENTRY DATE: 2017-08-21
  ref <313>: RELEVANT RESIDUES IN SEQ ID NO: (1)..(173)
MGTMKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKIGKEFKRIVQRIKDFLRNLVPRTES

SEQ ID NO: 53 - DNA, 972 bp, Homo sapiens
  ref <308>: DATABASE ACCESSION NUMBER: NCBI / NM_005091.2
  ref <309>: DATABASE ENTRY DATE: 2017-09-10
  ref <313>: RELEVANT RESIDUES IN SEQ ID NO: (1)..(972)
acggcggggcgaagcgcccaggggcctgtgcgtccctccctgctgagcgagggggcctgtcattgccgtgggcgtgacccagaccccaaccacagtgcatcccgccctggcccagccagagaaggaagctgagtctggggtctgctgggccagcaggaagtcccagcagggtgtgaagcaagactttccgggccactcctggaatcccccagcagataaaggcggcccctccaccgggcgctcctagcggtctcccggaccctgccgccctgccactatgtcccgccgctctatgctgcttgcctgggctctccccagcctccttcgactcggagcggctcaggagacagaagacccggcctgctgcagccccatagtgccccggaacgagtggaaggccctggcatcagagtgcgcccagcacctgagcctgcccttacgctatgtggtggtatcgcacacggcgggcagcagctgcaacacccccgcctcgtgccagcagcaggcccggaatgtgcagcactaccacatgaagacactgggctggtgcgacgtgggctacaacttcctgattggagaagacgggctcgtatacgagggccgtggctggaacttcacgggtgcccactcaggtcacttatggaaccccatgtccattggcatcagcttcatgggcaactacatggatcgggtgcccacaccccaggccatccgggcagcccagggtctactggcctgcggtgtggctcagggagccctgaggtccaactatgtgctcaaaggacaccgggatgtgcagcgtacactctctccaggcaaccagctctaccacctcatccagaattggccacactaccgctccccctgaggccctgctgatccgcaccccattcctcccctcccatggccaaaaaccccactgtctccttctccaataaagatgtagctcaaaaaaaaaaaaaaaaaaaaaaa

SEQ ID NO: 54 - protein, 196 aa, Homo sapiens
  ref <308>: DATABASE ACCESSION NUMBER: NCBI / NP_005082.1
  ref <309>: DATABASE ENTRY DATE: 2017-09-10
  ref <313>: RELEVANT RESIDUES IN SEQ ID NO: (1)..(196)
MSRRSMLLAWALPSLLRLGAAQETEDPACCSPIVPRNEWKALASECAQHLSLPLRYVVVSHTAGSSCNTPASCQQQARNVQHYHMKTLGWCDVGYNFLIGEDGLVYEGRGWNFTGAHSGHLWNPMSIGISFMGNYMDRVPTPQAIRAAQGLLACGVAQGALRSNYVLKGHRDVQRTLSPGNQLYHLIQNWPHYRSP

SEQ ID NO: 55 - DNA, 1852 bp, Homo sapiens
  ref <308>: DATABASE ACCESSION NUMBER: NCBI / NM_001101
  ref <309>: DATABASE ENTRY DATE: 2011-11-26
  ref <313>: RELEVANT RESIDUES IN SEQ ID NO: (1)..(1852)
accgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaaaaaaaaaaaaaaaaaaaaaaaaaaaaaaaaaaaaaaaaa

SEQ ID NO: 56 - DNA, 2408 bp, Homo sapiens
  ref <308>: DATABASE ACCESSION NUMBER: NCBI / NM_000043
  ref <309>: DATABASE ENTRY DATE: 2011-11-28
  ref <313>: RELEVANT RESIDUES IN SEQ ID NO: (1)..(2408)
aaacaccgctctggtcaccatggcaacagcgggatgccgcgaacggcttctgggcggggccggtccctcggacgattggacctagcttggcgcggaatccgtgaattgcccgcggcccgagggtgcagctcccggactgactggctctgcccttccccatggacgcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggcaaaaaaaaaaaaaaaaaa

SEQ ID NO: 57 - DNA, 1310 bp, Homo sapiens
  ref <308>: DATABASE ACCESSION NUMBER: NCBI / NM_002046
  ref <309>: DATABASE ENTRY DATE: 2011-11-21
  ref <313>: RELEVANT RESIDUES IN SEQ ID NO: (1)..(1310)
aaattgagcccgcagcctcccgcttcgctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacc

SEQ ID NO: 58 - DNA, 2439 bp, Homo sapiens
  ref <308>: DATABASE ACCESSION NUMBER: NCBI / NM_000291
  ref <309>: DATABASE ENTRY DATE: 2011-11-26
  ref <313>: RELEVANT RESIDUES IN SEQ ID NO: (1)..(2439)
gagagcagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaaaaaaaaaaaaaaaaaa

SEQ ID NO: 59 - DNA, 2226 bp, Homo sapiens
  ref <308>: DATABASE ACCESSION NUMBER: NCBI / NM_005566
  ref <309>: DATABASE ENTRY DATE: 2011-12-25
  ref <313>: RELEVANT RESIDUES IN SEQ ID NO: (1)..(2226)
gtctgccggtcggttgtctggctgcgcgcgccacccgggcctctccagtgccccgcctggctcggcatccacccccagcccgactcacacgtgggttcccgcacgtccgccggccccccccgctgacgtcagcatagctgttccacttaaggcccctcccgcgcccagctcagagtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatctttaaattcatcattcctaatgttgtaaaatacagcccgaactgcaagttgcttattgtttcaaatccagtggatatcttgacctacgtggcttggaagataagtggttttcccaaaaaccgtgttattggaagcggttgcaatctggattcagcccgattccgttacctaatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatatttgataataatgctaatcataattggaaagtaacattctatatgtaaatgtaaaatttatttgccaactgaatataggcaatgatagtgtgtcactatagggaacacagatttttgagatcttgtcctctggaagctggtaacaattaaaaacaatcttaaggcagggaaaaaaaaaaaaaaaaaa

SEQ ID NO: 60 - DNA, 1068 bp, Homo sapiens
  ref <308>: DATABASE ACCESSION NUMBER: NCBI / NM_002954
  ref <309>: DATABASE ENTRY DATE: 2011-11-28
  ref <313>: RELEVANT RESIDUES IN SEQ ID NO: (1)..(1068)
ctcgacctccttttaaaaattctcttagccacgttgattgtacgggaaaagcctttttaaaacatcttttacgttgcttaaacctacagtttcgaaagcattccgaaggctaaagtgagaaataagcccaggctagggagaggagaaacgaagttcacgtcctagtctggcaccgggttggattgtcgctgggacggcagtcaggcatttggtgtggtcgcctaaggggtgggtccttcggcgggagctccgggaaaccccgtgggcctgcgcggcgttcttccttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgtttatggcaagtcactttgacagacattattgtggcaaatgttgtctgacttactgtttcaacaaaccagaagacaagtaactgtatgagttaataaaagacatgaactaacatttattgttgggttttattgcagtaaaaagaatggtttttaagcaccaaattgatggtcacaccatttccttttagtagtgctactgctatcgctgtgtgaatgttgcctctggggattatgtgacccagtggttctgtatacctgccaggtgccaaccacttgtaaaggtcttgatattttcaattcttagactacctatactttggcagaagttatatttaatgtaagttgtctaaatataa

SEQ ID NO: 61 - DNA, 748 bp, Homo sapiens
  ref <308>: DATABASE ACCESSION NUMBER: NCBI / NM_000981
  ref <309>: DATABASE ENTRY DATE: 2011-12-17
  ref <313>: RELEVANT RESIDUES IN SEQ ID NO: (1)..(748)
gcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgcaaaaaaaaaaaaaaaa

SEQ ID NO: 62 - DNA, 644 bp, Homo sapiens
  ref <308>: DATABASE ACCESSION NUMBER: NCBI / NM_000975
  ref <309>: DATABASE ENTRY DATE: 2011-12-19
  ref <313>: RELEVANT RESIDUES IN SEQ ID NO: (1)..(644)
aaggccctcggccggaagctccgctttctcttcctgctctccatcatggcgcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccaaggcagaagaaatcttggagaagggtctaaaggtgcgggagtatgagttaagaaaaaacaacttctcagatactggaaactttggttttgggatccaggaacacatcgatctgggtatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcatccttcctggcaaataaattcccgtttctatccaaaagagcaataaaaagttttcagtgaaatgtgcaaaaaaaaaaaa

SEQ ID NO: 63 - DNA, 3114 bp, Homo sapiens
  ref <308>: DATABASE ACCESSION NUMBER: NCBI / NM_007363
  ref <309>: DATABASE ENTRY DATE: 2011-12-24
  ref <313>: RELEVANT RESIDUES IN SEQ ID NO: (1)..(3114)
caggcgcagtgcaggactgctccgagcacgcctacgcgcgcattttctccccttcctctccctctttccactttcctctccctttttctcctctcctttccccctcccaccacttggtctttcagtctttcagtcagttcgtttaggtctctccttccgacccccacccccagctcctctccctttccttttccccctccccctttcctttcccgtctcacgcgccaggccgcttgcacatgcgcattaggtacaaagcctcgctctttgtccccatctgtcgttcacacgaactcaagcctttggcattcggcagccaatagaatctaagaaatggcggaaaaatgattccgcctcgggagctaaaccttgattggcagtttagctaaccaatcgagaacgccattttgtaccccttggcaggcaccgagctccgtcgtctcgtttccggcggtcgcgcgctcttttctcgggacgggagaggccgtgtagcgtcgccgttactccgaggagataccagtcggtagaggagaagtcgaggttagagggaactgggaggcactttgctgtctgcaatcgaagttgagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaaatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacatttcctcgtcctgtgactgtggagcccatggaccagttagatgatgaagagggacttccagagaagctggttataaaaaaccagcaatttcacaaggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacaggatttgatgaggcgccaagaagaacttcggaggatggaagagctgcacaaccaagaggtgcaaaaacgaaagcaactggagctcaggcaggaggaagagcgcaggcgccgtgaagaagagatgcggcggcagcaagaagaaatgatgcggcgacagcaggaaggattcaagggaaccttccctgatgcgagagagcaggagattcggatgggtcagatggctatgggaggtgctatgggcataaacaacagaggtgccatgccccctgctcctgtgccagctggtaccccagctcctccaggacctgccactatgatgccggatggaactttgggattgaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctcccgggttcaagcttgtccaggttgatcttgaactcctgacctcgtgatctacccacctcggcctcccaaaatgctgggattacaggggtgagccaccgtgcccaacctcacttgcttcttatccttacactcccccagccccagagaaactgccacatacaccacaaaaaccaaacatcccccaatgaccttagccccattgctccattcactcccaggtgagaattcaggcaaacgtccacaaaggtcacaggcagcgtacatacggttctgttataccccatatattaccccttcatgtcctaaagaagacattttctcttagagattttcattttagtgtatctttaaaaaaaaatcttgtgttaacttgcctccatctttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaaaaaaaaaaaa

SEQ ID NO: 64 - DNA, 1956 bp, Homo sapiens
  ref <308>: DATABASE ACCESSION NUMBER: NCBI / NM_004309
  ref <309>: DATABASE ENTRY DATE: 2011-11-28
  ref <313>: RELEVANT RESIDUES IN SEQ ID NO: (1)..(1956)
gagcggaagtctcgtgaccccggaagtgacaggcagggcgggcggggcggccgacgacgttcgtcatttagtgcgggagggatcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaaggaggccctgctgggccgcgtggccgtttccgcagaccccaacgtccccaacgtcgtggtgactggcctgaccctggtgtgcagctcggccccgggccccctggagctggacctgacgggcgacctggagagcttcaagaagcagtcgtttgtgctgaaggagggtgtggagtaccggataaaaatctctttccgggttaaccgagagatagtgtccggcatgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgcttcacagacgacgacaagaccgaccacctgtcctgggagtggaatctcaccatcaagaaggactggaaggactgagcccagccagaggcgggcagggcagactgacggacggacgacggacaggcggatgtgtcccccccagcccctcccctccccataccaaagtgctgacaggccctccgtgcccctcccaccctggtccgcctccctggcctggctcaaccgagtgcctccgacccccctcctcagccctcccccacccacaggcccagcctcctcggtctcctgtctcgttgctgcttctgcctgtgctgtgggggagagaggccgcagccaggcctctgctgccctttctgtgccccccaggttctatctccccgtcacacccgaggcctggcttcaggagggagcggagcagccattctccaggccccgtggttgcccctggacgtgtgcgtctgctgctccggggtggagctggggtgtgggatgcacggcctcgtgggggccgggccgtcctccagccccgctgctccctggccagcccccttgtcgctgtcggtcccgtctaaccatgatgccttaacatgtggagtgtaccgtggggcctcactagcctctaactccctgtgtctgcatgagcatgtggcctccccgtcccttccccggtggcgaacccagtgacccagggacacgtggggtgtgctgctgctgctccccagcccaccagtgcctggccagcctgcccccttccctggacagggctgtggagatggctccggcggcttggggaaagccaaattgccaaaactcaagtcacctcagtaccatccaggaggctgggtattgtcctgcctctgccttttctgtctcagcgggcagtgcccagagcccacacccccccaagagccctcgatggacagcctcacccaccccacctgggcccagccaggagccccgcctggccatcagtatttattgcctccgtccgtgccgtccctgggccactggcctggcgcctgttcccccaggctctcagtgccaccacccccggcaggccttccctgacccagccaggaacaaacaagggaccaagtgcacacattgctgagagccgtctcctgtgcctcccccgccccatccccggtcttcgtgttgtgtctgccaggctcaggcagaggcgcctgtccctgcttcttttctgaccgggaaataaatgcccctgaaggaaaaaaaaaaaaaaaaaaaaaaaaaaaaaaaaaaaaaaaaaaaaaaaaaaa

SEQ ID NO: 65 - DNA, 1668 bp, Homo sapiens
  ref <308>: DATABASE ACCESSION NUMBER: NCBI / NM_000994
  ref <309>: DATABASE ENTRY DATE: 2011-11-28
  ref <313>: RELEVANT RESIDUES IN SEQ ID NO: (1)..(1668)
aggggttacgacccatcagcccttgcgcgccaccgtcccttctctcttcctcggcgctgcctacggaggtggcagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactgccatctggcatcttccttccttgattttaagtcttcagcttcttggccaacttagtttgccacagagattgttcttttgcttaagcccctttggaatctcccatttggaggggatttgtaaaggacactcagtccttgaacaggggaatgtggcctcaagtgcacagactagccttagtcatctccagttgaggctgggtatgaggggtacagacttggccctcacaccaggtaggttctgagacacttgaagaagcttgtggctcccaagccacaagtagtcattcttagccttgcttttgtaaagttaggtgacaagttattccatgtgatgcttgtgagaattgagaaaatatgcatggaaatatccagatgaatttcttacacagattcttacgggatgcctaaattgcatcctgtaacttctgtccaaaaagaacaggatgatgtacaaattgctcttccaggtaatccaccacggttaactggaaaagcactttcagtctcctataaccctcccaccagctgctgcttcaggtataatgttacagcagtttgccaaggcggggacctaactggtgacaattgagcctcttgactggtactcagaatttagtgacacgtggtcctgattttttttggagacggggtcttgctctcacccaggctgggagtgcagtggcacactgactacagccttgacctccccaggctcaggtgatcttcccacctcagccttccaagtagctgggactacagatgcacacctccaaacctgggtagtttttgaagtttttttgtagaggtggtctagccatgttgcctaggctcccgaactcctgagctcaagcaatcctgcttcagcctcccaaagtactgggattacaggcatcttctgtagtatataggtcatgagggatatgggatgtggtacttatgagacagaaatgcttacaggatgtttttctgtaaccatcctggtcaacttagcagaaatgctgcgctgggtataataaagcttttctacttctagtctagacaggaatcttacagattgtctcctgttcaaaacctagtcataaatatttataatgcaaactggtcaaaaaaaaaaaaaaaaaa

SEQ ID NO: 66 - DNA, 2594 bp, Homo sapiens
  ref <308>: DATABASE ACCESSION NUMBER: NCBI / NM_021009
  ref <309>: DATABASE ENTRY DATE: 2011-12-24
  ref <313>: RELEVANT RESIDUES IN SEQ ID NO: (1)..(2594)
aggggccgcggagccgcggctaaggaacgcgggccgcccacccgctcccggtgcagcggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattccttctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcaaatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaaaaaaaaaaaa

SEQ ID NO: 67 - DNA, 1526 bp, Homo sapiens
  ref <308>: DATABASE ACCESSION NUMBER: NCBI / NM_000190.3
  ref <309>: DATABASE ENTRY DATE: 2017-10-01
  ref <313>: RELEVANT RESIDUES IN SEQ ID NO: (1)..(1526)
ccggaagtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtgtaaaaaaaaaaaaaaaaa

SEQ ID NO: 68 - protein, 361 aa, Homo sapiens [sequence omitted]

SEQ ID NO: 69 - DNA, 1428 bp, Homo sapiens
  ref <308>: DATABASE ACCESSION NUMBER: NCBI / NM_001024382.1
  ref <309>: DATABASE ENTRY DATE: 2017-10-01
  ref <313>: RELEVANT RESIDUES IN SEQ ID NO: (1)..(1428)
agtgtcctggttactgcagcggcagcaacagcaggtcctactatcgcctccctctagtctctgcttctctggatccctgaggagggcagaaggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtgtaaaaaaaaaaaaaaaaa

SEQ ID NO: 70 - protein, 344 aa, Homo sapiens
  ref <308>: DATABASE ACCESSION NUMBER: NCBI / NP_001019553.1
  ref <309>: DATABASE ENTRY DATE: 2017-10-01
  ref <313>: RELEVANT RESIDUES IN SEQ ID NO: (1)..(344)
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQGALGVEVRAKDQDILDLVGVLHDPETLLRCIAERAFLRHLEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 71 - DNA, 1406 bp, Homo sapiens
  ref <308>: DATABASE ACCESSION NUMBER: NCBI / NM_001258208.1
  ref <309>: DATABASE ENTRY DATE: 2017-10-03
  ref <313>: RELEVANT RESIDUES IN SEQ ID NO: (1)..(1406)
ccggaagtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtgtaaaaaaaaaaaaaaaaa

SEQ ID NO: 72 - protein, 321 aa, Homo sapiens
  ref <308>: DATABASE ACCESSION NUMBER: NCBI / NP_001245137.1
  ref <309>: DATABASE ENTRY DATE: 2017-10-03
  ref <313>: RELEVANT RESIDUES IN SEQ ID NO: (1)..(321)
MSGNGNAAATAEENSPKMRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 73 - DNA, 1497 bp, Homo sapiens
  ref <308>: DATABASE ACCESSION NUMBER: NCBI / NM_001258209.1
  ref <309>: DATABASE ENTRY DATE: 2017-10-03
  ref <313>: RELEVANT RESIDUES IN SEQ ID NO: (1)..(1497)
ccggaagtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccaggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtgtaaaaaaaaaaaaaaaaa

SEQ ID NO: 74 - protein, 304 aa, Homo sapiens
  ref <308>: DATABASE ACCESSION NUMBER: NCBI / NP_001245138.1
  ref <309>: DATABASE ENTRY DATE: 2017-10-03
  ref <313>: RELEVANT RESIDUES IN SEQ ID NO: (1)..(304)
MRVIRVGTRKSQLARIQTDSVVATLKASYPGLQFEIIAMSTTGDKILDTALSKIGEKSLFTKELEHALEKNEVDLVVHSLKDLPTVLPPGFTIGAICKRENPHDAVVFHPKFVGKTLETLPEKSVVGTSSLRRAAQLQRKFPHLEFRSIRGNLNTRLRKLDEQQEFSAIILATAGLQRMGWHNRVGQILHPEECMYAVGQEGGCSVPVAVHTAMKDGQLYLTGGVWSLDGSDSIQETMQATIHVPAQHEDGPEDDPQLVGITARNIPRGPQLAAQNLGISLANLLLSKGAKNILDVARQLNDAH

SEQ ID NO: 75 - DNA, 1719 bp, Homo sapiens
  ref <308>: DATABASE ACCESSION NUMBER: NCBI / NM_001172085.1
  ref <309>: DATABASE ENTRY DATE: 2017-10-02
  ref <313>: RELEVANT RESIDUES IN SEQ ID NO: (1)..(1719)
ggcggaagtgacattatcaacgcgcgccaggggttcagtgaggtcgggcaggttcgctgtggcgggcgcctgggccgccggctgtttaacttcgcttccgctggcccatagtgatctttgcagtgacccagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgttaaaaaaaaaaaaaaaaaa

SEQ ID NO: 76 - protein, 319 aa, Homo sapiens
  ref <308>: DATABASE ACCESSION NUMBER: NCBI / NP_001165556.1
  ref <309>: DATABASE ENTRY DATE: 2017-10-02
  ref <313>: RELEVANT RESIDUES IN SEQ ID NO: (1)..(319)
MTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 77 - DNA, 1921 bp, Homo sapiens
  ref <308>: DATABASE ACCESSION NUMBER: NCBI / NM_003194.4
  ref <309>: DATABASE ENTRY DATE: 2017-10-02
  ref <313>: RELEVANT RESIDUES IN SEQ ID NO: (1)..(1921)
ggcggaagtgacattatcaacgcgcgccaggggttcagtgaggtcgggcaggttcgctgtggcgggcgcctgggccgccggctgtttaacttcgcttccgctggcccatagtgatctttgcagtgacccagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgttaaaaaaaaaaaaaaaaaa

SEQ ID NO: 78 - protein, 339 aa, Homo sapiens
  ref <308>: DATABASE ACCESSION NUMBER: NCBI / NP_003185.1
  ref <309>: DATABASE ENTRY DATE: 2017-10-02
  ref <313>: RELEVANT RESIDUES IN SEQ ID NO: (1)..(339)
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 79 - DNA, 3020 bp, Homo sapiens
  ref <308>: DATABASE ACCESSION NUMBER: NCBI / NM_001135699.1
  ref <309>: DATABASE ENTRY DATE: 2017-10-09
  ref <313>: RELEVANT RESIDUES IN SEQ ID NO: (1)..(3020)
tgtcccctcgcgcagtcaccgagcgcagatcccgcgctctcgattggaacgcctccccatcactcagccacactcaggggctggacgcctcactcccgtttccgagccataaaaggtctaggaccgcttcccccgagccagcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaaaaaaaaaaa

SEQ ID NO: 80 - protein, 245 aa, Homo sapiens
  ref <308>: DATABASE ACCESSION NUMBER: NCBI / NP_001129171.1
  ref <309>: DATABASE ENTRY DATE: 2017-10-09
  ref <313>: RELEVANT RESIDUES IN SEQ ID NO: (1)..(245)
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 81 - DNA, 2974 bp, Homo sapiens
  ref <308>: DATABASE ACCESSION NUMBER: NCBI / NM_001135700.1
  ref <309>: DATABASE ENTRY DATE: 2017-10-09
  ref <313>: RELEVANT RESIDUES IN SEQ ID NO: (1)..(2974)
ggcggggaggggccgggggcctcggggacccaagcgcgagggaaaggcctggccgagagcgggccggagcccaggcctggcgcggcggcgcccgccagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaaaaaaaaaaa

SEQ ID NO: 82 - protein, 245 aa, Homo sapiens; identical to SEQ ID NO: 80
  ref <308>: DATABASE ACCESSION NUMBER: NCBI / NP_001129172.1
  ref <309>: DATABASE ENTRY DATE: 2017-10-09
  ref <313>: RELEVANT RESIDUES IN SEQ ID NO: (1)..(245)

SEQ ID NO: 83 - DNA, 3023 bp, Homo sapiens
  ref <308>: DATABASE ACCESSION NUMBER: NCBI / NM_001135701.1
  ref <309>: DATABASE ENTRY DATE: 2017-10-09
  ref <313>: RELEVANT RESIDUES IN SEQ ID NO: (1)..(3023)
ggcggggaggggccgggggcctcggggacccaagcgcgagggaaaggcctggccgagagcgggccggagcccaggcctggcgcggcggcgcccgccaggtagaccggggcgaggctgcgcgccggcgggaggggagtccactgcgggaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaaaaaaaaaaa

SEQ ID NO: 84 - protein, 245 aa, Homo sapiens; identical to SEQ ID NO: 80
  ref <308>: DATABASE ACCESSION NUMBER: NCBI / NP_001129173.1
  ref <309>: DATABASE ENTRY DATE: 2017-10-09
  ref <313>: RELEVANT RESIDUES IN SEQ ID NO: (1)..(245)

SEQ ID NO: 85 - DNA, 3042 bp, Homo sapiens
  ref <308>: DATABASE ACCESSION NUMBER: NCBI / NM_001135702.1
  ref <309>: DATABASE ENTRY DATE: 2017-10-09
  ref <313>: RELEVANT RESIDUES IN SEQ ID NO: (1)..(3042)
gacacagatccgccatgacaaaggaggagagtcggggacttgagccgtggctccgacttgggcggagcctggaggggggtggttgcgatacgcggaccggagaatttgcactttaaagtccgggtctgcccgttttcgtttcacagtaaccgacgtctcaagtcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaaaaaaaaaaa

SEQ ID NO: 86 - protein, 245 aa, Homo sapiens; identical to SEQ ID NO: 80
  ref <308>: DATABASE ACCESSION NUMBER: NCBI / NP_001129174.1
  ref <309>: DATABASE ENTRY DATE: 2017-10-09
  ref <313>: RELEVANT RESIDUES IN SEQ ID NO: (1)..(245)

SEQ ID NO: 87 - DNA, 3003 bp, Homo sapiens
  ref <308>: DATABASE ACCESSION NUMBER: NCBI / NM_003406.3
  ref <309>: DATABASE ENTRY DATE: 2017-10-09
  ref <313>: RELEVANT RESIDUES IN SEQ ID NO: (1)..(3003)
ctttctccttccccttcttccgggctcccgtcccggctcatcacccggcctgtggcccactcccaccgccagctggaaccctggggactacgacgtccctcaaaccttgcttctaggagataaaaagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaaaaaaaaaaa

SEQ ID NO: 88 - protein, 245 aa, Homo sapiens; identical to SEQ ID NO: 80
  ref <308>: DATABASE ACCESSION NUMBER: NCBI / NP_003397.1
  ref <309>: DATABASE ENTRY DATE: 2017-10-09
  ref <313>: RELEVANT RESIDUES IN SEQ ID NO: (1)..(245)

SEQ ID NO: 89 - DNA, 3077 bp, Homo sapiens
  ref <308>: DATABASE ACCESSION NUMBER: NCBI / NM_145690.2
  ref <309>: DATABASE ENTRY DATE: 2017-10-09
  ref <313>: RELEVANT RESIDUES IN SEQ ID NO: (1)..(3077)
gcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaaaaaaaaaaa

SEQ ID NO: 90 - protein, 245 aa, Homo sapiens; identical to SEQ ID NO: 80
  ref <308>: DATABASE ACCESSION NUMBER: NCBI / NP_663723.1
  ref <309>: DATABASE ENTRY DATE: 2017-10-09
  ref <313>: RELEVANT RESIDUES IN SEQ ID NO: (1)..(245)

SEQ ID NO: 91 - DNA, 2058 bp, Homo sapiens
  ref <308>: DATABASE ACCESSION NUMBER: NCBI / NM_000024.5
  ref <309>: DATABASE ENTRY DATE: 2018-10-14
  ref <313>: RELEVANT RESIDUES IN SEQ ID NO: (1)..(2058)
gcacataacgggcagaacgcactgcgaagcggcttcttcagagcacgggctggaactggcaggcaccgcgagcccctagcacccgacaagctgagtgtgcaggacgagtccccaccacacccacaccacagccgctgaatgaggcttccaggcgtccgctcgcggcccgcagagccccgccgtgggtccgcccgctgaggcgcccccagccagtgcgctcacctgccagactgcgcgccatggggcaacccgggaacggcagcgccttcttgctggcacccaatagaagccatgcgccggaccacgacgtcacgcagcaaagggacgaggtgtgggtggtgggcatgggcatcgtcatgtctctcatcgtcctggccatcgtgtttggcaatgtgctggtcatcacagccattgccaagttcgagcgtctgcagacggtcaccaactacttcatcacttcactggcctgtgctgatctggtcatgggcctggcagtggtgccctttggggccgcccatattcttatgaaaatgtggacttttggcaacttctggtgcgagttttggacttccattgatgtgctgtgcgtcacggccagcattgagaccctgtgcgtgatcgcagtggatcgctactttgccattacttcacctttcaagtaccagagcctgctgaccaagaataaggcccgggtgatcattctgatggtgtggattgtgtcaggccttacctccttcttgcccattcagatgcactggtaccgggccacccaccaggaagccatcaactgctatgccaatgagacctgctgtgacttcttcacgaaccaagcctatgccattgcctcttccatcgtgtccttctacgttcccctggtgatcatggtcttcgtctactccagggtctttcaggaggccaaaaggcagctccagaagattgacaaatctgagggccgcttccatgtccagaaccttagccaggtggagcaggatgggcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaaggaagtttacatcctcctaaattggataggctatgtcaattctggtttcaatccccttatctactgccggagcccagatttcaggattgccttccaggagcttctgtgcctgcgcaggtcttctttgaaggcctatgggaatggctactccagcaacggcaacacaggggagcagagtggatatcacgtggaacaggagaaagaaaataaactgctgtgtgaagacctcccaggcacggaagactttgtgggccatcaaggtactgtgcctagcgataacattgattcacaagggaggaattgtagtacaaatgactcactgctgtaaagcagtttttctacttttaaagacccccccccccaacagaacactaaacagactatttaacttgagggtaataaacttagaataaaattgtaaaattgtatagagatatgcagaaggaagggcatccttctgccttttttatttttttaagctgtaaaaagagagaaaacttatttgagtgattatttgttatttgtacagttcagttcctctttgcatggaatttgtaagtttatgtctaaagagctttagtcctagaggacctgagtctgctatattttcatgacttttccatgtatctacctcactattcaagtattaggggtaatatattgctgctggtaatttgtatctgaaggagattttccttcctacacccttggacttgaggattttgagtatctcggacctttcagctgtgaacatggactcttcccccactcctcttatttgctcacacggggtattttaggcagggatttgaggagcagcttcagttgttttcccgagcaaagtctaaagtttacagtaaataaattgtttgaccatgccttcattgcaaaaaaaaaaaaaaaaa

SEQ ID NO: 92 - protein, 413 aa, Homo sapiens
  ref <308>: DATABASE ACCESSION NUMBER: NCBI / NP_000015.1
  ref <309>: DATABASE ENTRY DATE: 2018-10-14
  ref <313>: RELEVANT RESIDUES IN SEQ ID NO: (1)..(413)
MGQPGNGSAFLLAPNRSHAPDHDVTQQRDEVWVVGMGIVMSLIVLAIVFGNVLVITAIAKFERLQTVTNYFITSLACADLVMGLAVVPFGAAHILMKMWTFGNFWCEFWTSIDVLCVTASIETLCVIAVDRYFAITSPFKYQSLLTKNKARVIILMVWIVSGLTSFLPIQMHWYRATHQEAINCYANETCCDFFTNQAYAIASSIVSFYVPLVIMVFVYSRVFQEAKRQLQKIDKSEGRFHVQNLSQVEQDGRTGHGLRRSSKFCLKEHKALKTLGIIMGTFTLCWLPFFIVNIVHVIQDNLIRKEVYILLNWIGYVNSGFNPLIYCRSPDFRIAFQELLCLRRSSLKAYGNGYSSNGNTGEQSGYHVEQEKENKLLCEDLPGTEDFVGHQGTVPSDNIDSQGRNCSTNDSLL

SEQ ID NO: 93 - DNA, 1319 bp, Homo sapiens
  ref <308>: DATABASE ACCESSION NUMBER: NCBI / NM_000710.3
  ref <309>: DATABASE ENTRY DATE: 2018-07-01
  ref <313>: RELEVANT RESIDUES IN SEQ ID NO: (1)..(1319)
agcacttcccagaagagaaaactcctccaaaagcagctctcactatcagaaaacccaactacagttgtgaacgccttcattttctgcctgaggtctcagtccgtcggcccagactgaagtgcagtggcacaatcatagctcgctgcagcctcgaccttccaggcttaaacgattctcccacctcagcctctcgagttgctgggaccacaggtcactgtgcatggcatcatcctggccccctctagagctccaatcctccaaccagagccagctcttccctcaaaatgctacggcctgtgacaatgctccagaagcctgggacctgctgcacagagtgctgccaacatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagccggaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggctgcgatcgtcttcttcaactaccacatcctggcctccctgcgaacgcgggaggaggtcagcaggacaaggtgcgggggccgcaaggatagcaagaccacagcgctgatcctcacgctcgtggttgccttcctggtctgctgggccccttaccacttctttgccttcctggaattcttattccaggtgcaagcagtccgaggctgcttttgggaggacttcattgacctgggcctgcaattggccaacttctttgccttcactaacagctccctgaatccagtaatttatgtctttgtgggccggctcttcaggaccaaggtctgggaactttataaacaatgcacccctaaaagtcttgctccaatatcttcatcccataggaaagaaatcttccaacttttctggcggaattaaaacagcattgaaccaagaaaaaaaaaaaaaaaaaaaa

SEQ ID NO: 94 - protein, 353 aa, Homo sapiens
  ref <308>: DATABASE ACCESSION NUMBER: NCBI / NP_000701.2
  ref <309>: DATABASE ENTRY DATE: 2018-07-01
  ref <313>: RELEVANT RESIDUES IN SEQ ID NO: (1)..(353)
MASSWPPLELQSSNQSQLFPQNATACDNAPEAWDLLHRVLPTFIISICFFGLLGNLFVLLVFLLPRRQLNVAEIYLANLAASDLVFVLGLPFWAENIWNQFNWPFGALLCRVINGVIKANLFISIFLVVAISQDRYRVLVHPMASRRQQRRRQARVTCVLIWVVGGLLSIPTFLLRSIQAVPDLNITACILLLPHEAWHFARIVELNILGFLLPLAAIVFFNYHILASLRTREEVSRTRCGGRKDSKTTALILTLVVAFLVCWAPYHFFAFLEFLFQVQAVRGCFWEDFIDLGLQLANFFAFTNSSLNPVIYVFVGRLFRTKVWELYKQCTPKSLAPISSSHRKEIFQLFWRN

SEQ ID NO: 95 - DNA, 4190 bp, Homo sapiens
  ref <308>: DATABASE ACCESSION NUMBER: NCBI / NM_004244.5
  ref <309>: DATABASE ENTRY DATE: 2018-09-02
  ref <313>: RELEVANT RESIDUES IN SEQ ID NO: (1)..(4190)
atatgtagccttttcattttcatgaaagtgaagtgatttttagaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctatctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcagaaaattcccatgagtcagctgatttcagtgctgctgaactaatttctgtgtctaaatttcttcctatttctggaatggaaaaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaatgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgagggcac

SEQ ID NO: 96 - protein, 1156 aa, Homo sapiens
  ref <308>: DATABASE ACCESSION NUMBER: NCBI / NP_004235.4
  ref <309>: DATABASE ENTRY DATE: 2018-09-02
  ref <313>: RELEVANT RESIDUES IN SEQ ID NO: (1)..(1156)
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSENSHESADFSAAELISVSKFLPISGMEKEAILSHTEKENGNL

SEQ ID NO: 97 - DNA, 4107 bp, Homo sapiens
  ref <308>: DATABASE ACCESSION NUMBER: NCBI / NM_203416.3
  ref <309>: DATABASE ENTRY DATE: 2018-09-02
  ref <313>: RELEVANT RESIDUES IN SEQ ID NO: (1)..(4107)
atatgtagccttttcattttcatgaaagtgaagtgatttttagaattcttagttgttttctttagaagaacatttctagggaataatacaagaagatttaggaatcattgaagttataaatctttggaatgagcaaactcagaatggtgctacttgaagactctggatctgctgacttcagaagacattttgtcaacttgagtcccttcaccattactgtggtcttacttctcagtgcctgttttgtcaccagttctcttggaggaacagacaaggagctgaggctagtggatggtgaaaacaagtgtagcgggagagtggaagtgaaagtccaggaggagtggggaacggtgtgtaataatggctggagcatggaagcggtctctgtgatttgtaaccagctgggatgtccaactgctatcaaagcccctggatgggctaattccagtgcaggttctggacgcatttggatggatcatgtttcttgtcgtgggaatgagtcagctctttgggattgcaaacatgatggatggggaaagcatagtaactgtactcaccaacaagatgctggagtgacctgctcagatggatccaatttggaaatgaggctgacgcgtggagggaatatgtgttctggaagaatagagatcaaattccaaggacggtggggaacagtgtgtgatgataacttcaacatagatcatgcatctgtcatttgtagacaacttgaatgtggaagtgctgtcagtttctctggttcatctaattttggagaaggctctggaccaatctggtttgatgatcttatatgcaacggaaatgagtcagctctctggaactgcaaacatcaaggatggggaaagcataactgtgatcatgctgaggatgctggagtgatttgctcaaagggagcagatctgagcctgagactggtagatggagtcactgaatgttcaggaagattagaagtgagattccaaggagaatgggggacaatatgtgatgacggctgggacagttacgatgctgctgtggcatgcaagcaactgggatgtccaactgccgtcacagccattggtcgagttaacgccagtaagggatttggacacatctggcttgacagcgtttcttgccagggacatgaacctgctatctggcaatgtaaacaccatgaatggggaaagcattattgcaatcacaatgaagatgctggcgtgacatgttctgatggatcagatctggagctaagacttagaggtggaggcagccgctgtgctgggacagttgaggtggagattcagagactgttagggaaggtgtgtgacagaggctggggactgaaagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgcaagaactggcaatggggtggacttacctgtgatcactatgaagaagccaaaattacctgctcagcccacagggaacccagactggttggaggggacattccctgttctggacgtgttgaagtgaagcatggtgacacgtggggctccatctgtgattcggacttctctctggaagctgccagcgttctatgcagggaattacagtgtggcacagttgtctctatcctggggggagctcactttggagagggaaatggacagatctgggctgaagaattccagtgtgagggacatgagtcccatctttcactctgcccagtagcaccccgcccagaaggaacttgtagccacagcagggatgttggagtagtctgctcaagatacacagaaattcgcttggtgaatggcaagaccccgtgtgagggcagagtggagctcaaaacgcttggtgcctggggatccctctgtaactctcactgggacatagaagatgcccatgttctttgccagcagcttaaatgtggagttgccctttctaccccaggaggagcacgttttggaaaaggaaatggtcagatctggaggcatatgtttcactgcactgggactgagcagcacatgggagattgtcctgtaactgctctaggtgcttcattatgtccttcagagcaagtggcctctgtaatctgctcaggaaaccagtcccaaacactgtcctcgtgcaattcatcgtctttgggcccaacaaggcctaccattccagaagaaagtgctgtggcctgcatagagagtggtcaacttcgcctggtaaatggaggaggtcgctgtgctgggagagtagagatctatcatgagggctcctggggcaccatctgtgatgacagctgggacctgagtgatgcccacgtggtttgcagacagctgggctgtggagaggccattaatgccactggttctgctcattttggggaaggaacagggcccatctggctggatgagatgaaatgcaatggaaaagaatcccgcatttggcagtgccattcacacggctgggggcagcaaaattgcaggcacaaggaggatgcgggagttatctgctcagaattcatgtctctgagactgaccagtgaagccagcagagaggcctgtgcagggcgtctggaagttttttacaatggagcttggggcactgttggcaagagtagcatgtctgaaaccactgtgggtgtggtgtgcaggcagctgggctgtgcagacaaagggaaaatcaaccctgcatctttagacaaggccatgtccattcccatgtgggtggacaatgttcagtgtccaaaaggacctgacacgctgtggcagtgcccatcatctccatgggagaagagactggccagcccctcggaggagacctggatcacatgtgacaacaagataagacttcaggaaggacccacttcctgttctggacgtgtggagatctggcatggaggttcctgggggacagtgtgtgatgactcttgggacttggacgatgctcaggtggtgtgtcaacaacttggctgtggtccagctttgaaagcattcaaagaagcagagtttggtcaggggactggaccgatatggctcaatgaagtgaagtgcaaagggaatgagtcttccttgtgggattgtcctgccagacgctggggccatagtgagtgtgggcacaaggaagacgctgcagtgaattgcacagatatttcagtgcagaaaaccccacaaaaagccacaacaggtcgctcatcccgtcagtcatcctttattgcagtcgggatccttggggttgttctgttggccattttcgtcgcattattcttcttgactaaaaagcgaagacagagacagcggcttgcagtttcctcaagaggagagaacttagtccaccaaattcaataccgggagatgaattcttgcctgaatgcagatgatctggacctaatgaattcctcaggaggccattctgagccacactgaaaaggaaaatgggaatttataacccagtgagttcagcctttaagataccttgatgaagacctggactattgaatggagcagaaattcacctctctcactgactattacagttgcatttttatggagttcttcttctcctaggattcctaagactgctgctgaatttataaaaattaagtttgtgaatgtgactacttagtggtgtatatgagactttcaagggaattaaataaataaataagaatgttattgatttgagtttgctttaattacttgtccttaattctattaatttctaaatgggcttcctaattttttgtagagtttcctagatgtattataatgtgttttatttgacagtgtttcaatttgcatatacagtactgtatattttttcttatttggtttgaataattttcctattaccaaataaaaataaatttatttttactttagtttttctaagacaggaaaagttaatgatattgaagggtctgtaaataatatatggctaactttataaggcatgactcacaacgattctttaactgctttttgttactgtaattctgttcactagaataaaatgcagagccacacctggtgagggcac

SEQ ID NO: 98 - protein, 1121 aa, Homo sapiens
  ref <308>: DATABASE ACCESSION NUMBER: NCBI / NP_981961.2
  ref <309>: DATABASE ENTRY DATE: 2018-09-02
  ref <313>: RELEVANT RESIDUES IN SEQ ID NO: (1)..(1121)
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

SEQ ID NO: 99 - DNA, 2796 bp, Homo sapiens
  ref <308>: DATABASE ACCESSION NUMBER: NCBI / NM_000574.4
  ref <309>: DATABASE ENTRY DATE: 2018-09-24
  ref <313>: RELEVANT RESIDUES IN SEQ ID NO: (1)..(2796)
agcgagctcctcctccttcccctccccactctccccgagtctagggcccccggggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctgttttgttgttgaagtactttaaatttcatacgttcatggcatttcactgtaaagactttaatgtgtatttcttaaaataaaactttttttcctccttaa

SEQ ID NO: 100 - protein, 381 aa, Homo sapiens
  ref <308>: DATABASE ACCESSION NUMBER: NCBI / NP_000565.1
  ref <309>: DATABASE ENTRY DATE: 2018-09-24
  ref <313>: RELEVANT RESIDUES IN SEQ ID NO: (1)..(381)
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 101 - DNA, 2914 bp, Homo sapiens
  ref <308>: DATABASE ACCESSION NUMBER: NCBI / NM_001114752.2
  ref <309>: DATABASE ENTRY DATE: 2018-07-15
  ref <313>: RELEVANT RESIDUES IN SEQ ID NO: (1)..(2914)
agcgagctcctcctccttcccctccccactctccccgagtctagggcccccggggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctggttctcgtcctgtcacccaggctggtatgcggtggtgtgatcgtagctcactgcagtctcgaactcctgggttcaagcgatccttccacttcagcctcccaagtagctggtactacagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctgttttgttgttgaagtactttaaatttcatacgttcatggcatttcactgtaaagactttaatgtgtatttcttaaaataaaactttttttcctccttaa

SEQ ID NO: 102 - protein, 440 aa, Homo sapiens
  ref <308>: DATABASE ACCESSION NUMBER: NCBI / NP_001108224.1
  ref <309>: DATABASE ENTRY DATE: 2018-07-15
  ref <313>: RELEVANT RESIDUES IN SEQ ID NO: (1)..(440)
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGSRPVTQAGMRWCDRSSLQSRTPGFKRSFHFSLPSSWYYRAHVFHVDRFAWDASNHGLADLAKEELRRKYTQVYRLFLVS

SEQ ID NO: 103 - DNA, 2646 bp, Homo sapiens
  ref <308>: DATABASE ACCESSION NUMBER: NCBI / NM_001710.5
  ref <309>: DATABASE ENTRY DATE: 2018-09-16
  ref <313>: RELEVANT RESIDUES IN SEQ ID NO: (1)..(2646)
gacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaacaaaaaaaaaaaaaaaaaaaa

SEQ ID NO: 104 - protein, 764 aa, Homo sapiens
  ref <308>: DATABASE ACCESSION NUMBER: NCBI / NP_001701.2
  ref <309>: DATABASE ENTRY DATE: 2018-09-16
  ref <313>: RELEVANT RESIDUES IN SEQ ID NO: (1)..(764)
MGSNLSPQLCLMPFILGLLSGGVTTTPWSLARPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 105 - DNA, 2484 bp, Homo sapiens
  ref <308>: DATABASE ACCESSION NUMBER: CBI / NM_022570.4
  ref <309>: DATABASE ENTRY DATE: 2018-08-26
  ref <313>: RELEVANT RESIDUES IN SEQ ID NO: (1)..(2484)
agcatagtttcatttcctgctcttgaatatctggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatgggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatctttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaaaaaaaaaaaa

SEQ ID NO: 106 - protein, 201 aa, Homo sapiens
  ref <308>: DATABASE ACCESSION NUMBER: NCBI  / NP_072092
  ref <309>: DATABASE ENTRY DATE: 2018-08-26
  ref <313>: RELEVANT RESIDUES IN SEQ ID NO: (1)..(201)
MEYHPDLENLDEDGYTQLHFDSQSNTRIAVVSEKGSCAASPPWRLIAVILGILCLVILVIAVVLGTMGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 107 - DNA, 2622 bp, Homo sapiens
  ref <308>: DATABASE ACCESSION NUMBER: NCBI /  NM_197947.2
  ref <309>: DATABASE ENTRY DATE: 2018-08-26
  ref <313>: RELEVANT RESIDUES IN SEQ ID NO: (1)..(2622)
agcatagtttcatttcctgctcttgaatatctggttgaactacttaagcttaatttgttaaactccggtaagtacctagcccacatgatttgactcagagattctcttttgtccacagacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctatttggagatccaattcaggaagcaacacattggagaatggctactttctatcaagaaataaagagaaccacagtcaacccacacaatcatctttagaagacagtgtgactcctaccaaagctgtcaaaaccacaggggttctttccagcccttgtcctcctaattggattatatatgagaagagctgttatctattcagcatgtcactaaattcctgggatggaagtaaaagacaatgctggcaactgggctctaatctcctaaagatagacagctcaaatgaattgggatttatagtaaaacaagtgtcttcccaacctgataattcattttggataggcctttctcggccccagactgaggtaccatggctctgggaggatggatcaacattctcttctaacttatttcagatcagaaccacagctacccaagaaaacccatctccaaattgtgtatggattcacgtgtcagtcatttatgaccaactgtgtagtgtgccctcatatagtatttgtgagaagaagttttcaatgtaagaggaagggtggagaaggagagagaaatatgtgaggtagtaaggaggacagaaaacagaacagaaaagagtaacagctgaggtcaagataaatgcagaaaatgtttagagagcttggccaactgtaatcttaaccaagaaattgaagggagaggctgtgatttctgtatttgtcgacctacaggtaggctagtattatttttctagttagtagatccctagacatggaatcagggcagccaagcttgagtttttattttttatttatttatttttttgagatagggtctcactttgttacccaggctggagtgcagtggcacaatctcgactcactgcagctatctctcgcctcagcccctcaagtagctgggactacaggtgcatgccaccatgccaggctaatttttggtgttttttgtagagactgggttttgccatgttgaccaagctggtctctaactcctgggcttaagtgatctgcccgccttggcctcccaaagtgctgggattacagatgtgagccaccacacctggccccaagcttgaattttcattctgccattgacttggcatttaccttgggtaagccataagcgaatcttaatttctggctctatcagagttgtttcatgctcaacaatgccattgaagtgcacggtgtgttgccacgatttgaccctcaacttctagcagtatatcagttatgaactgagggtgaaatatatttctgaatagctaaatgaagaaatgggaaaaaatcttcaccacagtcagagcaattttattattttcatcagtatgatcataattatgattatcatcttagtaaaaagcaggaactcctactttttctttatcaattaaatagctcagagagtacatctgccatatctctaatagaatctttttttttttttttttttttgagacagagtttcgctcttgttgcccaggctggagtgcaacggcacgatctcggctcaccgcaacctccgccccctgggttcaagcaattctcctgcctcagcctcccaagtagctgggattacagtcaggcaccaccacacccggctaattttgtatttttttagtagagacagggtttctccatgtcggtcagggtagtcccgaactcctgacctcaagtgatctgcctgcctcggcctcccaagtgctgggattacaggcgtgagccactgcacccagcctagaatcttgtataatatgtaattgtagggaaactgctctcataggaaagttttctgctttttaaatacaaaaatacataaaaatacataaaatctgatgatgaatataaaaaagtaaccaacctcattggaacaagtattaacattttggaatatgttttattagttttgtgatgtactgttttacaatttttaccatttttttcagtaattactgtaaaatggtattattggaatgaaactatatttcctcatgtgctgatttgtcttatttttttcatactttcccactggtgctatttttatttccaatggatatttctgtattactagggaggcatttacagtcctctaatgttgattaatatgtgaaaagaaattgtaccaattttactaaattatgcagtttaaaatggatgattttatgttatgtggatttcatttcaataaaaaaaaactcttatcaaaaaaaaaaaaaaaa

SEQ ID NO: 108 - protein, 247 aa, Homo sapiens
  ref <308>: DATABASE ACCESSION NUMBER: NCBI / NP_922938.1
  ref <309>: DATABASE ENTRY DATE: 2018-08-26
  ref <313>: RELEVANT RESIDUES IN SEQ ID NO: (1)..(247)
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 109 - DNA, 1184 bp, Homo sapiens
  ref <308>: DATABASE ACCESSION NUMBER: NCBI /  NM_001511.3
  ref <309>: DATABASE ENTRY DATE: 2018-09-02
  ref <313>: RELEVANT RESIDUES IN SEQ ID NO: (1)..(1184)
cacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatagaaaaaactcgtttgatttttggggggaaacaagggctacctttactggaaaatctggtgatttataaaaaaaaaaaaaaaa

SEQ ID NO: 110 - protein, 107 aa, Homo sapiens
  ref <308>: DATABASE ACCESSION NUMBER: NCBI / NP_001502.1
  ref <309>: DATABASE ENTRY DATE: 2018-09-02
  ref <313>: RELEVANT RESIDUES IN SEQ ID NO: (1)..(107)
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 111 - DNA, 1166 bp, Homo sapiens
  ref <308>: DATABASE ACCESSION NUMBER: NCBI / NM_002090.2
  ref <309>: DATABASE ENTRY DATE: 2018-07-29
  ref <313>: RELEVANT RESIDUES IN SEQ ID NO: (1)..(1166)
gctccgggaatttccctggcccggccgctccgggctttccagtctcaaccatgcataaaaagggttcgccgatcttggggagccacacagcccgggtcgcaggcacctccccgccagctctcccgcttctcgcacagcttcccgacgcgtctgctgagccccatggcccacgccacgctctccgccgcccccagcaatccccggctcctgcgggtggcgctgctgctcctgctcctggtggccgccagccggcgcgcagcaggagcgtccgtggtcactgaactgcgctgccagtgcttgcagacactgcagggaattcacctcaagaacatccaaagtgtgaatgtaaggtcccccggaccccactgcgcccaaaccgaagtcatagccacactcaagaatgggaagaaagcttgtctcaaccccgcatcccccatggttcagaaaatcatcgaaaagatactgaacaaggggagcaccaactgacaggagagaagtaagaagcttatcagcgtatcattgacacttcctgcagggtggtccctgcccttaccagagctgaaaatgaaaaagagaacagcagctttctagggacagctggaaaggacttaatgtgtttgactatttcttacgagggttctacttatttatgtatttatttttgaaagcttgtattttaatattttacatgctgttatttaaagatgtgagtgtgtttcatcaaacatagctcagtcctgattatttaattggaatatgatgggttttaaatgtgtcattaaactaatatttagtgggagaccataatgtgtcagccaccttgataaatgacagggtggggaactggagggtggggggattgaaatgcaagcaattagtggatcactgttagggtaagggaatgtatgtacacatctattttttatactttttttttaaaaaaagaatgtcagttgttatttattcaaattatctcacattatgtgttcaacatttttatgctgaagtttcccttagacattttatgtcttgcttgtagggcataatgccttgtttaatgtccattctgcagcgtttctctttcccttggaaaagagaatttatcattactgttacatttgtacaaatgacatgataataaaagttttatgaaaaaaaaaaaaaaa

SEQ ID NO: 112 - protein, 107 aa, Homo sapiens
  ref <308>: DATABASE ACCESSION NUMBER: NCBI / NP_002081.2
  ref <309>: DATABASE ENTRY DATE: 2018-07-29
  ref <313>: RELEVANT RESIDUES IN SEQ ID NO: (1)..(107)
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 113 - DNA, 2505 bp, Homo sapiens
  ref <308>: DATABASE ACCESSION NUMBER: NCBI / NM_002994.4
  ref <309>: DATABASE ENTRY DATE: 2018-10-13
  ref <313>: RELEVANT RESIDUES IN SEQ ID NO: (1)..(2505)
agtggggagagatgagtgtagataaaaggagtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgcgctgttggtgctgctgctgctgctgacgcagccagggcccatcgccagcgctggtcctgccgctgctgtgttgagagagctgcgttgcgtttgtttacagaccacgcaaggagttcatcccaaaatgatcagtaatctgcaagtgttcgccataggcccacagtgctccaaggtggaagtggtagcctccctgaagaacgggaaggaaatttgtcttgatccagaagccccttttctaaagaaagtcatccagaaaattttggacggtggaaacaaggaaaactgattaagagaaatgagcacgcatggaaaagtttcccagtcttcagcagagaagttttctggaggtctctgaacccagggaagacaagaaggaaagattttgttgttgtttgtttatttgtttttccagtagttagctttcttcctggattcctcactttgaagagtgtgaggaaaacctatgtttgccgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgttaaaaacaaaacaaaacaaaaaaaaacaaggagaagttgtccaagggatgtcaattttttatccctctgtatgggttagattttccaaaatcataatttgaagaaggccagcatttatggtagaatatataattatatataaggtggccacgctggggcaagttccctccccactcacagctttggcccctttcacagagtagaacctgggttagaggattgcagaagacgagcggcagcggggagggcagggaagatgcctgtcgggtttttagcacagttcatttcactgggattttgaagcatttctgtctgaatgtaaagcctgttctagtcctggtgggacacactggggttgggggtgggggaagatgcggtaatgaaaccggttagtcagtgttgtcttaatatccttgataatgctgtaaagtttatttttacaaatatttctgtttaagctatttcacctttgtttggaaatccttcccttttaaagagaaaatgtgacacttgtgaaaaggcttgtaggaaagctcctccctttttttctttaaacctttaaatgacaaacctaggtaattaatggttgtgaatttctatttttgctttgtttttaatgaacatttgtctttcagaataggattctgtgataatatttaaatggcaaaaacaaaacataattttgtgcaattaacaaagctactgcaagaaaaataaaacatttcttggtaaaaacgtatgtatttatatattatatatttatatataatatatattatatatttagcattgctgagctttttagatgcctattgtgtatcttttaaaggttttgaccattttgttatgagtaattacatatatattacattcactatattaaaattgtacttttttactatgtgtctcattggttcatagtctttattttgtcctttgaataaacattaaaagatttctaaacttcaaaaaaaaaaaaaaaaaa

SEQ ID NO: 114 - protein, 114 aa, Homo sapiens
  ref <308>: DATABASE ACCESSION NUMBER: NCBI / NP_002985.1
  ref <309>: DATABASE ENTRY DATE: 2018-10-13
  ref <313>: RELEVANT RESIDUES IN SEQ ID NO: (1)..(114)
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 115 - DNA, 4628 bp, Homo sapiens
  ref <308>: DATABASE ACCESSION NUMBER: NCBI / NM_001432.2
  ref <309>: DATABASE ENTRY DATE: 2018-10-14
  ref <313>: RELEVANT RESIDUES IN SEQ ID NO: (1)..(4628)
tcacttgcctgatatttccagtgtcagagggacacagccaacgtggggtcccttctaggctgacagccgctctccagccactgccgcgagcccgtctgctcccgccctgcccgtgcactctccgcagccgccctccgccaagccccagcgcccgctcccatcgccgatgaccgcggggaggaggatggagatgctctgtgccggcagggtccctgcgctgctgctctgcctgggtttccatcttctacaggcagtcctcagtacaactgtgattccatcatgtatcccaggagagtccagtgataactgcacagctttagttcagacagaagacaatccacgtgtggctcaagtgtcaataacaaagtgtagctctgacatgaatggctattgtttgcatggacagtgcatctatctggtggacatgagtcaaaactactgcaggtgtgaagtgggttatactggtgtccgatgtgaacacttctttttaaccgtccaccaacctttaagcaaagaatatgtggctttgaccgtgattcttattattttgtttcttatcacagtcgtcggttccacatattatttctgcagatggtacagaaatcgaaaaagtaaagaaccaaagaaggaatatgagagagttacctcaggggatccagagttgccgcaagtctgaatggcgccatcaaacttatgggcagggataacagtgtgcctggttaatattaatattcccattttattaataatatttatgttgggtcaagtgttaggtcaataacactgtattttaatgtacttgaaaaatgtttttatttttgttttatttttgacagactatttgctaatgtataatgtgcagaaaatatttaatatcaaaagaaaattgatatttttatacaagtaatttcctgagctaaatgcttcattgaaagcttcaaagtttatatgcctggtgcacagtgcttagaagtaagcaattcccaggtcatagctcaagaattgttagcaaatgacagatttctgtaagcctatatatatagtcaaatcgatttagtaagtatgttttttatgttcctcaaatcagtgataattggtttgactgtaccatggtttgatatgtagttggcaccatggtatcatatattaaaacaataatgcaattagaatttgggagaagcaaatataggtcctgtgttaaacactacacatttgaaacaagctaaccctggggagtctatggtctcttcactcaggtctcagctataattctgttatatgaggggcagtggacagttccctatgccaactcacgactcctacaggtactagtcactcatctaccagattctgcctatgtaaaatgaattgaaaaacaattttctgtaatcttttatttaagtagtgggcatttcatagcttcacaatgttccttttttgtatattacaacatttatgtgaggtaattattgctcaacagacaattagaaaaaagtccacacttgaagcctaaatttgtgctttttaagaatatttttagactatttctttttataggggctttgctgaattctaacattaaatcacagcccaaaatttgatggactaattattattttaaaatatatgaagacaataattctacatgttgtcttaagatggaaatacagttatttcatcttttattcaaggaagttttaactttaatacagctcagtaaatggcttcttctagaatgtaaagttatgtatttaaagttgtatcttgacacaggaaatgggaaaaaacttaaaaattaatatggtgtatttttccaaatgaaaaatctcaattgaaagcttttaaaatgtagaaacttaaacacaccttcctgtggaggctgagatgaaaactagggctcattttcctgacatttgtttattttttggaagagacaaagatttcttctgcactctgagcccataggtctcagagagttaataggagtatttttgggctattgcataaggagccactgctgccaccacttttggattttatgggaggctccttcatcgaatgctaaacctttgagtagagtctccctggatcacataccaggtcagggaggatctgttcttcctctacgtttatcctggcatgtgctagggtaaacgaaggcataataagccatggctgacctctggagcaccaggtgccaggacttgtctccatgtgtatccatgcattatataccctggtgcaatcacacgactgtcatctaaagtcctggccctggcccttactattaggaaaataaacagacaaaaacaagtaaatatatatggtcatatacatattgtatatatattcatatacaaacatgtatgtatacatgaccttaatggatcatagaattgcagtcatttggtgctctgctaaccatttatataaaacttaaaaacaagagaaaagaaaaatcaattagatctaaacagttatttctgtttcctatttaatacagctgaagtcaaaatatgtaagaacacattttaaatactctacttacagttggccctctgtggttagttccacatctgtggattcaaccaaccaaggacggaaaatgcttaaaaaataatacaacaacaacaaaaaatacattataacaactatttacttttttttttttctttttgagatggagtctcgctctgttgcccaggttggagtgcagtggcacgatctcggctcactgcaacctcacctcccgggttcaagagatcctcctgcctcagcctcctgagcagctgggactacaggcgcatgccaccatgcccagctaatttttgtatttttagtagaggcggggtttcaccatgttggccaggatggtctcaatctcctaaccttgagatccaccctccacagcctcccaaactgctgggattacaggtgtgagccaccgcacgtagcatttacattaggtattacaagtaatgtaaagatgatttaagtatacaggaggatgtgaataggttatatgcaagcactatgcccttttatataagtgacttgaacatctgtgcccgattttagtatgtgcaggggggcgatctgggaatcagtcccctgtggataccaaggtacaactgtatttattaacgcttactagatgtgaggagagtctgaatattttcagtgatcttggctgtttcaaaaaaatctattgacttttcaataaatcagctgcaatccatttatttcatttacaaaagatttattgtaagcatctcaatcttggtttgtcagtttatcttaagcatgtcaattcataaaaacaagtcatttttgtatttttcatctttaagaatgcttaaaaaagctaatccctaaaatagttagatctttgtaaatgcatattaaataataaagtatgacccacattactttttatgggtgaaaataagacaaaaataatagttttagtgaggatggtgctgagtaaacataaaaactgatttgctctcagctgatgtgtcctgtacacagtgggaagattttagttcacacttagtctaactcccccattttacagatttctcactatatatatttctagaaggggctatgcatattcaatgtattgagaaccaaagcaaccacaaatgcataaatgcataatttatggtcttcaaccaaggccacataataacccagttaacttactctttaaccaggaatattaagttctataactagtactcaaggtttaaccttaaaattaagatttccttaaccttaaccttaaaattgatattatattaaacatacataatacaatgtaactccactgttctcctgaatattttttgctctaatctctctgccgaaagtcaaagtgatgggagaattggtatactggtatgactacgtcttaagtcagatttttatttatgagtctttgagactaaattcaatcaccaccaggtatcaaatcaacttttatgcagcaaatatatgattctagtgtctgacttttgttaaattcagtaatgcagtttttaaaaacctgtatctgacccactttgtaatttttgctccaatatccattctgtagacttttgaaaaaaaagtttttaatttgatgcccaatatattctgaccgttaaaaaattcttgttcatatgggagaagggggagtaatgacttgtacaaacagtatttctggtgtatattttaatgtttttaaaaagagtaatttcatttaaatatctgttattcaaatttgatgatgttaaatgtaatataatgtattttctttttattttgcactctgtaattgcactttttaagtttgaagagccattttggtaaacggtttttattaaagatgctatggaacataaagttgtattgcatgcaatttgaagtaacttatttgactatgaatgttatcggattactgaattgtatcaatttgtttgtgttcaatatcagctttgataattgtgtaccttaagatattgaaggagaaaatagataatttacaagatattattaatttttatttatttttcttgggaattgaaaaaaattgaaataaataaaaatgcattgaacatcttgcattcaaaatcttcactgac

SEQ ID NO: 116 - protein, 169 aa, Homo sapiens
  ref <308>: DATABASE ACCESSION NUMBER: NCBI / NP_001423.1
  ref <309>: DATABASE ENTRY DATE: 2018-10-14
  ref <313>: RELEVANT RESIDUES IN SEQ ID NO: (1)..(169)
MTAGRRMEMLCAGRVPALLLCLGFHLLQAVLSTTVIPSCIPGESSDNCTALVQTEDNPRVAQVSITKCSSDMNGYCLHGQCIYLVDMSQNYCRCEVGYTGVRCEHFFLTVHQPLSKEYVALTVILIILFLITVVGSTYYFCRWYRNRKSKEPKKEYERVTSGDPELPQV

SEQ ID NO: 117 - DNA, 8742 bp, Homo sapiens
  ref <308>: DATABASE ACCESSION NUMBER: NCBI / NM_001306129.1
  ref <309>: DATABASE ENTRY DATE: 2018-10-09
  ref <313>: RELEVANT RESIDUES IN SEQ ID NO: (1)..(8742)
acgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaagtatttgaatagtaaaaaaaaaaaaaaaaaaa

SEQ ID NO: 118 - protein, 2446 aa, Homo sapiens
  ref <308>: DATABASE ACCESSION NUMBER: NCBI / NP_001293058.1
  ref <309>: DATABASE ENTRY DATE: 2018-10-09
  ref <313>: RELEVANT RESIDUES IN SEQ ID NO: (1)..(2446)
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 119 - DNA, 8205 bp, Homo sapiens
  ref <308>: DATABASE ACCESSION NUMBER: NCBI / NM_001306130.1
  ref <309>: DATABASE ENTRY DATE: 2018-10-09
  ref <313>: RELEVANT RESIDUES IN SEQ ID NO: (1)..(8205)
acgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaagtatttgaatagtaaaaaaaaaaaaaaaaaaa

SEQ ID NO: 120 - protein, 2267 aa, Homo sapiens
  ref <308>: DATABASE ACCESSION NUMBER: NCBI / NP_001293059.1
  ref <309>: DATABASE ENTRY DATE: 2018-10-09
  ref <313>: RELEVANT RESIDUES IN SEQ ID NO: (1)..(2267)
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 121 - DNA, 2292 bp, Homo sapiens
  ref <308>: DATABASE ACCESSION NUMBER: NCBI / NM_001114377.1
  ref <309>: DATABASE ENTRY DATE: 2018-09-23
  ref <313>: RELEVANT RESIDUES IN SEQ ID NO: (1)..(2292)
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctccccacaaaaaaaaaaaaaaaa

SEQ ID NO: 122 - protein, 396 aa, Homo sapiens
  ref <308>: DATABASE ACCESSION NUMBER: NCBI / NP_001107849.1
  ref <309>: DATABASE ENTRY DATE: 2018-09-23
  ref <313>: RELEVANT RESIDUES IN SEQ ID NO: (1)..(396)
MPNPRPGKPSAPSLALGPSPGASPSWRAAPKASDLLGARGPGGTFQGRDLRGGAHASSSSLNPMPPSQLQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 123 - DNA, 2397 bp, Homo sapiens
  ref <308>: DATABASE ACCESSION NUMBER: NCBI / NM_014009.3
  ref <309>: DATABASE ENTRY DATE: 2018-09-23
  ref <313>: RELEVANT RESIDUES IN SEQ ID NO: (1)..(2397)
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctgcccacactgcccctagtcatggtggcaccctccggggcacggctgggccccttgccccacttacaggcactcctccaggacaggccacatttcatgcaccagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctccccacaaaaaaaaaaaaaaaa

SEQ ID NO: 124 - protein, 431 aa, Homo sapiens
  ref <308>: DATABASE ACCESSION NUMBER: NCBI / NP_054728.2
  ref <309>: DATABASE ENTRY DATE: 2018-09-23
  ref <313>: RELEVANT RESIDUES IN SEQ ID NO: (1)..(431)
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 125 - DNA, 1473 bp, Homo sapiens
  ref <308>: DATABASE ACCESSION NUMBER: NCBI / NM_010391.4
  ref <309>: DATABASE ENTRY DATE: 2018-07-17
  ref <313>: RELEVANT RESIDUES IN SEQ ID NO: (1)..(1473)
agacgccccggatcccagatgggggcgatggcgccgcgcacgctgctcctgctgctggcggctgccctggccccgacccagacccaggcaggctcacactccatgaggtatttcgaaacctccgtttcccggccgggccttggggagccccggttcattattgtcggttacgtggacgacacgcagttcgtgcgcttcgacagcgacgcggagactccgaggatggagccgcgggcgccttggatggagcaggaggggccggagtattgggagcgggagacacagagagccaagggcaatgagcagagtttccatgtgagcctgaggaccctgctcggctactacaaccagagcgagagcggctctcacacgatccagtggatgtatggctgtaaagtggggtccgacgggcgcttcctccgcgggtacctgcaatacgcatacgacggccgcgattacattgccctgaacgaagacctgaaaacgtggacggcagcggacgtggcggcgattatcacccgacgcaagtgggagcaggctggtgctgcagagtattacagggcctacctggaggccgagtgcgtggagtggctcctcagatacctggagctcgggaaggagacgctgctgcgcacagatcccccaaagacacatgtgacccatcacccaggatctgaaggtgatgtcaccctgaggtgttgggccctgggcttctaccctgctgacatcaccctgacctggcagttgaatggggaggagctgacccaggacatggaactggtggagaccaggcctgcaggggatggaaccttccagaagtgggcatctgtggtggtgcctcttgggaaggagcagaattacacatgccatgtgtaccatgaggggctgcctgagcccctcaccctgagatgggaacctcctccttccactgactctatcatgtcacacattgctgatctgctgtggccatcattaaagctctggtggtatttgtgatgaagagaaggagaaacacaggtagaaaaagaggggactatgctcccgctccagtgtgaagacacctgactggagtggactgagtgacaaccagtgtgttcaggtctctcctgtgacatccagagccctcagttctctttagacaacagtgtctgatgttctctgtgttcctgtgggctcaatgtgaagaactgtgtagcccagcctgccctgcacaccaggaccctgtccctgcattgcttgctcccttctacagtcagccttccaactccagccaaacactgggagacatctgcatcctgtgagctccacgctaccctaagctgcagctcctcacttccacactgagaataagaatctggatgtgaactttattgttcatatccttgatctgagggttgattgacaggtaaactaaagaattaagaatacttagagtttgtggaggaaataaatggcagatggagaaccttccag

SEQ ID NO: 126 - protein, 325 aa, Homo sapiens
  ref <308>: DATABASE ACCESSION NUMBER: NCBI / NP_034521
  ref <309>: DATABASE ENTRY DATE: 2018-07-17
  ref <313>: RELEVANT RESIDUES IN SEQ ID NO: (1)..(325)
MGAMAPRTLLLLLAAALAPTQTQAGSHSMRYFETSVSRPGLGEPRFIIVGYVDDTQFVRFDSDAETPRMEPRAPWMEQEGPEYWERETQRAKGNEQSFHVSLRTLLGYYNQSESGSHTIQWMYGCKVGSDGRFLRGYLQYAYDGRDYIALNEDLKTWTAADVAAIITRRKWEQAGAAEYYRAYLEAECVEWLLRYLELGKETLLRTDPPKTHVTHHPGSEGDVTLRCWALGFYPADITLTWQLNGEELTQDMELVETRPAGDGTFQKWASVVVPLGKEQNYTCHVYHEGLPEPLTLRWEPPPSTDSIMSHIADLLWPSLKLWWYL

SEQ ID NO: 127 - DNA, 2347 bp, Homo sapiens
  ref <308>: DATABASE ACCESSION NUMBER: NCBI / NM_002187.2
  ref <309>: DATABASE ENTRY DATE: 2018-09-02
  ref <313>: RELEVANT RESIDUES IN SEQ ID NO: (1)..(2347)
ctgtttcagggccattggactctccgtcctgcccagagcaagatgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccctgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatc

SEQ ID NO: 128 - protein, 328 aa, Homo sapiens
  ref <308>: DATABASE ACCESSION NUMBER: NCBI / NP_002178.2
  ref <309>: DATABASE ENTRY DATE: 2018-09-02
  ref <313>: RELEVANT RESIDUES IN SEQ ID NO: (1)..(328)
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 129 - DNA, 1498 bp, Homo sapiens
  ref <308>: DATABASE ACCESSION NUMBER: NCBI / NM_000576.2
  ref <309>: DATABASE ENTRY DATE: 2018-10-08
  ref <313>: RELEVANT RESIDUES IN SEQ ID NO: (1)..(1498)
accaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaag

SEQ ID NO: 130 - protein, 269 aa, Homo sapiens
  ref <308>: DATABASE ACCESSION NUMBER: NCBI / NP_000567.1
  ref <309>: DATABASE ENTRY DATE: 2018-10-08
  ref <313>: RELEVANT RESIDUES IN SEQ ID NO: (1)..(269)
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 131 - DNA, 1647 bp, Homo sapiens
  ref <308>: DATABASE ACCESSION NUMBER: NCBI / NM_153511.3
  ref <309>: DATABASE ENTRY DATE: 2018-09-29
  ref <313>: RELEVANT RESIDUES IN SEQ ID NO: (1)..(1647)
atcattacacctgggagctgcccaagctgggatttggtcttctagactttccataaggactctttcttgccatgtacctacaaacctacaaaaccctttgagtgcgcctctgagtgtggagctttctgcagttcagggttcagtgaatggacagatctgtcttgctgtaagtgatcctgtgagcgatcctgtgagcgatcctgtgagcgatcctgtgagcgatcctgtgagcgatcctgtgagtgatcctgtgagcaatcctgtgagagctctgtgcaccagaacaagatcacgatggaaaacaatgaaaaaaaaaacattgtgtatggaagtgatgttgagatggaacacgagagagctgggctatttgtatcttcagctatgttttctaaacacccattttctacacacatctcaggaagagaaactcctgactttggggaggtttttgacttggaccagcaggtgtggatctttcgtaatcaggcccttgtgacagttccacgaagccacagagtaaccccagtcagcgtgactatcctcccatgcaagtacccagagtctcttgaacaggacaaagggattgccatttatttgggaattcagaatccagataaatgcctgttttgtaaggaagttaatggacaccctactttgctgctaaaggaagagaagattttggatttgtaccaccaccctgagccaatgaagccattcctgttttaccacacccggacaggtggaacatccacctttgaatcagtggctttccctggccactatattgcctcctccaagactggcaaccccatcttcctcacatcaaaaaagggagaatattacaacattaacttcaatttagatataaagtcttaaactcagcatggaagtggagggttggttagaactcttcctcttaaaacatcaaacctctaatatgttatcatttgtttgatctatggtattttcatactgaaaggtaagcaggaccaacattatctcctttcatagatgaagaagcaacaaaataatgcatactccaaagtcggtgggattggagtggtgtaaggatgttctctaagactgaagtggtccaatctataagacatcatgtctgagaaatagggtgctgtgccacagtgtataaaacctagaatgccctgtgtgtgagtggtgacatcctcatttccagccattggcctgattcataccatgttttcacacatttgtaatatcaactccttgcatttggatagcagaggcctcacaatgacatttgcctcaacagctaatagctttgatctttcaatgctgtgtagatctgaatacactagaaaaggaattagaatcctgagtgaatgaactgtgaggagccgccctcacatttgccattataagatggcactgacagctgtgttctaagtggtaaacatagtctgcacacatgcaggggcagttttcccaccatgtgttctgcctttcccgtgatgacaactgggccgatgggctgcagccaatcagggagtaatacgtcctaggtggaggataattctccttaaaagggacggggttctggcactctctcccttccttgcttgctctcttgcactctggctcctgaagatgtaagcaataaagctttgccgc

SEQ ID NO: 132 - protein, 193 aa, Homo sapiens
  ref <308>: DATABASE ACCESSION NUMBER: NCBI / NP_705731.2
  ref <309>: DATABASE ENTRY DATE: 2018-09-29
  ref <313>: RELEVANT RESIDUES IN SEQ ID NO: (1)..(193)
MENNEKKNIVYGSDVEMEHERAGLFVSSAMFSKHPFSTHISGRETPDFGEVFDLDQQVWIFRNQALVTVPRSHRVTPVSVTILPCKYPESLEQDKGIAIYLGIQNPDKCLFCKEVNGHPTLLLKEEKILDLYHHPEPMKPFLFYHTRTGGTSTFESVAFPGHYIASSKTGNPIFLTSKKGEYYNINFNLDIKS

SEQ ID NO: 133 - DNA, 1197 bp, Homo sapiens
  ref <308>: DATABASE ACCESSION NUMBER: NCBI / NM_000600.4
  ref <309>: DATABASE ENTRY DATE: 2018-10-13
  ref <313>: RELEVANT RESIDUES IN SEQ ID NO: (1)..(1197)
gtctcaatattagagtctcaacccccaataaatataggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaaaaaaaaaa

SEQ ID NO: 134 - protein, 212 aa, Homo sapiens
  ref <308>: DATABASE ACCESSION NUMBER: NCBI / NP_000591.1
  ref <309>: DATABASE ENTRY DATE: 2018-10-13
  ref <313>: RELEVANT RESIDUES IN SEQ ID NO: (1)..(212)
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 135 - DNA, 1006 bp, Homo sapiens
  ref <308>: DATABASE ACCESSION NUMBER: NCBI / NM_001318095.1
  ref <309>: DATABASE ENTRY DATE: 2018-10-13
  ref <313>: RELEVANT RESIDUES IN SEQ ID NO: (1)..(1006)
gtctcaatattagagtctcaacccccaataaatataggactggagatgtctgaggctcattctgccctcgagcccaccgggaacgaaagagaagctctatctcccctccaggagcccagctatgaactccttctccacaaacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaaaaaaaaaa

SEQ ID NO: 136 - protein, 136 aa, Homo sapiens
  ref <308>: DATABASE ACCESSION NUMBER: NCBI / NP_001305024.1
  ref <309>: DATABASE ENTRY DATE: 2018-10-13
  ref <313>: RELEVANT RESIDUES IN SEQ ID NO: (1)..(136)
MCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 137 - DNA, 2672 bp, Homo sapiens
  ref <308>: DATABASE ACCESSION NUMBER: NCBI / NM_001168298.1
  ref <309>: DATABASE ENTRY DATE: 2018-10-13
  ref <313>: RELEVANT RESIDUES IN SEQ ID NO: (1)..(2672)
aagcagtggtgatagctgagaatatgcagccgttttctccttcctgggtacagtgctattctgcctagagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctctgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagtagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacggggtgaaaccctgtctctactaaaaatacaaaaaaaaaaaaaaattagccgggcgtggtggtgagtgcctgtaatcacagctacttgggaggctgagatgggagaatcacttgaacccgggaggcagaggttgcagtgagccgagattgtgcccctgcactccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgtttataaaaaaaaaaa

SEQ ID NO: 138 - protein, 360 aa, Homo sapiens
  ref <308>: DATABASE ACCESSION NUMBER: NCBI / NP_001161770.1
  ref <309>: DATABASE ENTRY DATE: 2018-10-13
  ref <313>: RELEVANT RESIDUES IN SEQ ID NO: (1)..(360)
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 139 - DNA, 2880 bp, Homo sapiens
  ref <308>: DATABASE ACCESSION NUMBER: NCBI / NM_001557.3
  ref <309>: DATABASE ENTRY DATE: 2018-10-13
  ref <313>: RELEVANT RESIDUES IN SEQ ID NO: (1)..(2880)
aggttcaaaacattcagagacagaaggtggatagacaaatctccaccttcagactggtaggctcctccagaagccatcagacaggaagatgtgaaaatccccagcactcatcccagaatcactaagtggcacctgtcctgggccaaagtcccaggacagacctcattgttcctctgtgggaatacctccccaggagggcatcctggatttcccccttgcaacccaggtcagaagtttcatcgtcaaggttgtttcatcttttttttcctgtctaacagctctgactaccacccaaccttgaggcacagtgaagacatcggtggccactccaataacagcaggtcacagctgctcttctggaggtgtcctacaggtgaaaagcccagcgacccagtcaggatttaagtttacctcaaaaatggaagattttaacatggagagtgacagctttgaagatttctggaaaggtgaagatcttagtaattacagttacagctctaccctgcccccttttctactagatgccgccccatgtgaaccagaatccctggaaatcaacaagtattttgtggtcattatctatgccctggtattcctgctgagcctgctgggaaactccctcgtgatgctggtcatcttatacagcagggtcggccgctccgtcactgatgtctacctgctgaacctagccttggccgacctactctttgccctgaccttgcccatctgggccgcctccaaggtgaatggctggatttttggcacattcctgtgcaaggtggtctcactcctgaaggaagtcaacttctatagtggcatcctgctactggcctgcatcagtgtggaccgttacctggccattgtccatgccacacgcacactgacccagaagcgctacttggtcaaattcatatgtctcagcatctggggtctgtccttgctcctggccctgcctgtcttacttttccgaaggaccgtctactcatccaatgttagcccagcctgctatgaggacatgggcaacaatacagcaaactggcggatgctgttacggatcctgccccagtcctttggcttcatcgtgccactgctgatcatgctgttctgctacggattcaccctgcgtacgctgtttaaggcccacatggggcagaagcaccgggccatgcgggtcatctttgctgtcgtcctcatcttcctgctctgctggctgccctacaacctggtcctgctggcagacaccctcatgaggacccaggtgatccaggagacctgtgagcgccgcaatcacatcgaccgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagtagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacggggtgaaaccctgtctctactaaaaatacaaaaaaaaaaaaaaattagccgggcgtggtggtgagtgcctgtaatcacagctacttgggaggctgagatgggagaatcacttgaacccgggaggcagaggttgcagtgagccgagattgtgcccctgcactccagcctgagcgacagtgagactctgtctcagtccatgaagatgtagaggagaaactggaactctcgagcgttgctgggggggattgtaaaatggtgtgaccactgcagaagacagtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagtttatgattccacctacatgaggtactgagagtgaacaaatttacagagacagaaagcagaacagtgattaccagggactgaggggaggggagcatgggaagtgacggtttaatgggcacagggtttatgtttaggatgttgaaaaagttctgcagataaacagtagtgatagttgtaccgcaatgtgacttaatgccactaaattgacacttaaaaatggtttaaatggtcaattttgttatgtatattttatatcaatttaaaaaaaaacctgagccccaaaaggtattttaatcaccaaggctgattaaaccaaggctagaaccacctgcctatattttttgttaaatgatttcattcaatatcttttttttaataaaccatttttacttgggtgtttataaaaaaaaaaa

SEQ ID NO: 140 - protein, 360 aa, Homo sapiens; identical to SEQ ID NO: 138
  ref <308>: DATABASE ACCESSION NUMBER: NCBI / NP_001548.1
  ref <309>: DATABASE ENTRY DATE: 2018-10-13
  ref <313>: RELEVANT RESIDUES IN SEQ ID NO: (1)..(360)

SEQ ID NO: 141 - DNA, 1644 bp, Homo sapiens
  ref <308>: DATABASE ACCESSION NUMBER: NCBI / NM_020997.3
  ref <309>: DATABASE ENTRY DATE: 2018-10-13
  ref <313>: RELEVANT RESIDUES IN SEQ ID NO: (1)..(1644)
acatccagctgcctgagaccctcctgcagccttctcaagggacagccccactctgcctcttgctcctccagggcagcaccatgcagcccctgtggctctgctgggcactctgggtgttgcccctggccagccccggggccgccctgaccggggagcagctcctgggcagcctgctgcggcagctgcagctcaaagaggtgcccaccctggacagggccgacatggaggagctggtcatccccacccacgtgagggcccagtacgtggccctgctgcagcgcagccacggggaccgctcccgcggaaagaggttcagccagagcttccgagaggtggccggcaggttcctggcgttggaggccagcacacacctgctggtgttcggcatggagcagcggctgccgcccaacagcgagctggtgcaggccgtgctgcggctcttccaggagccggtccccaaggccgcgctgcacaggcacgggcggctgtccccgcgcagcgcccgggcccgggtgaccgtcgagtggctgcgcgtccgcgacgacggctccaaccgcacctccctcatcgactccaggctggtgtccgtccacgagagcggctggaaggccttcgacgtgaccgaggccgtgaacttctggcagcagctgagccggccccggcagccgctgctgctacaggtgtcggtgcagagggagcatctgggcccgctggcgtccggcgcccacaagctggtccgctttgcctcgcagggggcgccagccgggcttggggagccccagctggagctgcacaccctggaccttggggactatggagctcagggcgactgtgaccctgaagcaccaatgaccgagggcacccgctgctgccgccaggagatgtacattgacctgcaggggatgaagtgggccgagaactgggtgctggagcccccgggcttcctggcttatgagtgtgtgggcacctgccggcagcccccggaggccctggccttcaagtggccgtttctggggcctcgacagtgcatcgcctcggagactgactcgctgcccatgatcgtcagcatcaaggagggaggcaggaccaggccccaggtggtcagcctgcccaacatgagggtgcagaagtgcagctgtgcctcggatggtgcgctcgtgccaaggaggctccagccataggcgcctagtgtagccatcgagggacttgacttgtgtgtgtttctgaagtgttcgagggtaccaggagagctggcgatgactgaactgctgatggacaaatgctctgtgctctctagtgagccctgaatttgcttcctctgacaagttacctcacctaatttttgcttctcaggaatgagaatctttggccactggagagcccttgctcagttttctctattcttattattcactgcactatattctaagcacttacatgtggagatactgtaacctgagggcagaaagcccaatgtgtcattgtttacttgtcctgtcactggatctgggctaaagtcctccaccaccactctggacctaagacctggggttaagtgtgggttgtgcatccccaatccagataataaagactttgtaaaacatgaataaaacacattttattctaaaaaaaaaaaaaaaaaaa

SEQ ID NO: 142 - protein, 366 aa, Homo sapiens
  ref <308>: DATABASE ACCESSION NUMBER: NCBI / NM_066277.1
  ref <309>: DATABASE ENTRY DATE: 2018-10-13
  ref <313>: RELEVANT RESIDUES IN SEQ ID NO: (1)..(366)
MQPLWLCWALWVLPLASPGAALTGEQLLGSLLRQLQLKEVPTLDRADMEELVIPTHVRAQYVALLQRSHGDRSRGKRFSQSFREVAGRFLALEASTHLLVFGMEQRLPPNSELVQAVLRLFQEPVPKAALHRHGRLSPRSARARVTVEWLRVRDDGSNRTSLIDSRLVSVHESGWKAFDVTEAVNFWQQLSRPRQPLLLQVSVQREHLGPLASGAHKLVRFASQGAPAGLGEPQLELHTLDLGDYGAQGDCDPEAPMTEGTRCCRQEMYIDLQGMKWAENWVLEPPGFLAYECVGTCRQPPEALAFKWPFLGPRQCIASETDSLPMIVSIKEGGRTRPQVVSLPNMRVQKCSCASDGALVPRRLQP

SEQ ID NO: 143 - DNA, 3808 bp, Homo sapiens
  ref <308>: DATABASE ACCESSION NUMBER: NCBI / NM_001257135.1
  ref <309>: DATABASE ENTRY DATE: 2018-09-30
  ref <313>: RELEVANT RESIDUES IN SEQ ID NO: (1)..(3808)
cttcctggactggggatcccggctaaatatagctgtttctgtcttacaacacaggctccagtatataaatcaggcaaattccccatttgagcatgaacctctgaaaactgccggcatctgaggtttcctccaaggccctctgaagtgcagcccataatgaaggtcttggcggcagtacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctagcaggaggtcttgaagtgtgctgtgaaccgagggatctcaggagttgggtccagatgtgggggcctgtccaagggtggctggggcccagggcatcgctaaacccaaatgggggctgctggcagaccccgagggtgcctggccagtccactccactctgggctgggctgtgatgaagctgagcagagtggaaacttccatagggagggagctagaagaaggtgccccttcctctgggagattgtggactggggagcgtgggctggacttctgcctctacttgtccctttggccccttgctcactttgtgcagtgaacaaactacacaagtcatctacaagagccctgaccacagggtgagacagcagggcccaggggagtggaccagcccccagcaaattatcaccatctgtgcctttgctgccccttaggttgggacttaggtgggccagaggggctaggatcccaaaggactccttgtcccctagaagtttgatgagtggaagatagagaggggcctctgggatggaaggctgtcttcttttgaggatgatcagagaacttgggcataggaacaatctggcagaagtttccagaaggaggtcacttggcattcaggctcttggggaggcagagaagccaccttcaggcctgggaaggaagacactgggaggaggagaggcctggaaagctttggtaggttcttcgttctcttccccgtgatcttccctgcagcctgggatggccagggtctgatggctggacctgcagcaggggtttgtggaggtgggtagggcaggggcaggttgctaagtcaggtgcagaggttctgagggacccaggctcttcctctgggtaaaggtctgtaagaaggggctggggtagctcagagtagcagctcacatctgaggccctgggaggccttgtgaggtcacacagaggtacttgagggggactggaggccgtctctggtccccagggcaagggaacagcagaacttagggtcagggtctcagggaaccctgagctccaagcgtgctgtgcgtctgacctggcatgatttctatttattatgatatcctatttatattaacttattggtgctttcagtggccaagttaattcccctttccctggtccctactcaacaaaatatgatgatggctcccgacacaagcgccagggccagggcttagcagggcctggtctggaagtcgacaatgttacaagtggaataagccttacgggtgaagctcagagaagggtcggatctgagagaatggggaggcctgagtgggagtggggggccttgctccacccccccccatcccctactgtgacttgctttagggtgtcagggtccaggctgcaggggctgggccaatttgtggagaggccgggtgcctttctgtcttgattccagggggctggttcacactgttcttgggcgccccagcattgtgttgtgaggcgcactgttcctggcagatattgtgccccctggagcagtgggcaagacagtccttgtggcccaccctgtccttgtttctgtgtccccatgctgcctctgaaatagcgccctggaacaaccctgcccctgcacccagcatgctccgacacagcagggaagctcctcctgtggcccggacacccatagacggtgcggggggcctggctgggccagaccccaggaaggtggggtagactggggggatcagctgcccattgctcccaagaggaggagagggaggctgcagatgcctgggactcagaccaggaagctgtgggccctcctgctccacccccatcccactcccacccatgtctgggctcccaggcagggaacccgatctcttcctttgtgctggggccaggcgagtggagaaacgccctccagtctgagagcaggggagggaaggaggcagcagagttggggcagctgctcagagcagtgttctggcttcttctcaaaccctgagcgggctgccggcctccaagttcctccgacaagatgatggtactaattatggtacttttcactcactttgcacctttccctgtcgctctctaagcactttacctggatggcgcgtgggcagtgtgcaggcaggtcctgaggcctggggttggggtggagggtgcggcccggagttgtccatctgtccatcccaacagcaagacgaggatgtggctgttgagatgtgggccacactcacccttgtccaggatgcagggactgccttctccttcctgcttcatccggcttagcttggggctggctgcattcccccaggatgggcttcgagaaagacaaacttgtctggaaaccagagttgctgattccacccggggggcccggctgactcgcccatcacctcatctccctgtggacttgggagctctgtgccaggcccaccttgcggccctggctctgagtcgctctcccacccagcctggacttggccccatgggacccatcctcagtgctccctccagatcccgtccggcagcttggcgtccaccctgcacagcatcactgaatcacagagcctttgcgtgaaacagctctgccaggccgggagctgggtttctcttccctttttatctgctggtgtggaccacacctgggcctggccggaggaagagagagtttaccaagagagatgtctccgggcccttatttattatttaaacatttttttaaaaagcactgctagtttacttgtctctcctccccatcgtccccatcgtcctccttgtccctgacttggggcacttccaccctgacccagccagtccagctctgccttgccggctctccagagtagacatagtgtgtggggttggagctctggcacccggggaggtagcatttccctgcagatggtacagatgttcctgccttagagtcatctctagttccccacctcaatcccggcatccagccttcagtcccgcccacgtgctagctccgtgggcccaccgtgcggccttagaggtttccctccttcctttccactgaaaagcacatggccttgggtgacaaattcctctttgatgaatgtaccctgtggggatgtttcatactgacagattatttttatttattcaatgtcatatttaaaatatttattttttataccaaatgaatacttttttttttaagaaaaaaaagagaaatgaataaagaatctactcttggctggcaaaaaaaaaaaaaaaaaa

SEQ ID NO: 144 - protein, 88 aa, Homo sapiens
  ref <308>: DATABASE ACCESSION NUMBER: NCBI / NP_001244064.1
  ref <309>: DATABASE ENTRY DATE: 2018-09-30
  ref <313>: RELEVANT RESIDUES IN SEQ ID NO: (1)..(88)
MKVLAAVHSPGGAVPQQPGQAMWPQRDGLPALPRQRHGEGQAGGAVPHSRVPWHLPGQHHPGPEDPQPQCPQPPQQAQRHRRHPARPP

SEQ ID NO: 145 - DNA, 3987 bp, Homo sapiens
  ref <308>: DATABASE ACCESSION NUMBER: NCBI / NM_002309.4
  ref <309>: DATABASE ENTRY DATE: 2018-09-30
  ref <313>: RELEVANT RESIDUES IN SEQ ID NO: (1)..(3987)
cttcctggactggggatcccggctaaatatagctgtttctgtcttacaacacaggctccagtatataaatcaggcaaattccccatttgagcatgaacctctgaaaactgccggcatctgaggtttcctccaaggccctctgaagtgcagcccataatgaaggtcttggcggcaggagttgtgcccctgctgttggttctgcactggaaacatggggcggggagccccctccccatcacccctgtcaacgccacctgtgccatacgccacccatgtcacaacaacctcatgaaccagatcaggagccaactggcacagctcaatggcagtgccaatgccctctttattctctattacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctagcaggaggtcttgaagtgtgctgtgaaccgagggatctcaggagttgggtccagatgtgggggcctgtccaagggtggctggggcccagggcatcgctaaacccaaatgggggctgctggcagaccccgagggtgcctggccagtccactccactctgggctgggctgtgatgaagctgagcagagtggaaacttccatagggagggagctagaagaaggtgccccttcctctgggagattgtggactggggagcgtgggctggacttctgcctctacttgtccctttggccccttgctcactttgtgcagtgaacaaactacacaagtcatctacaagagccctgaccacagggtgagacagcagggcccaggggagtggaccagcccccagcaaattatcaccatctgtgcctttgctgccccttaggttgggacttaggtgggccagaggggctaggatcccaaaggactccttgtcccctagaagtttgatgagtggaagatagagaggggcctctgggatggaaggctgtcttcttttgaggatgatcagagaacttgggcataggaacaatctggcagaagtttccagaaggaggtcacttggcattcaggctcttggggaggcagagaagccaccttcaggcctgggaaggaagacactgggaggaggagaggcctggaaagctttggtaggttcttcgttctcttccccgtgatcttccctgcagcctgggatggccagggtctgatggctggacctgcagcaggggtttgtggaggtgggtagggcaggggcaggttgctaagtcaggtgcagaggttctgagggacccaggctcttcctctgggtaaaggtctgtaagaaggggctggggtagctcagagtagcagctcacatctgaggccctgggaggccttgtgaggtcacacagaggtacttgagggggactggaggccgtctctggtccccagggcaagggaacagcagaacttagggtcagggtctcagggaaccctgagctccaagcgtgctgtgcgtctgacctggcatgatttctatttattatgatatcctatttatattaacttattggtgctttcagtggccaagttaattcccctttccctggtccctactcaacaaaatatgatgatggctcccgacacaagcgccagggccagggcttagcagggcctggtctggaagtcgacaatgttacaagtggaataagccttacgggtgaagctcagagaagggtcggatctgagagaatggggaggcctgagtgggagtggggggccttgctccacccccccccatcccctactgtgacttgctttagggtgtcagggtccaggctgcaggggctgggccaatttgtggagaggccgggtgcctttctgtcttgattccagggggctggttcacactgttcttgggcgccccagcattgtgttgtgaggcgcactgttcctggcagatattgtgccccctggagcagtgggcaagacagtccttgtggcccaccctgtccttgtttctgtgtccccatgctgcctctgaaatagcgccctggaacaaccctgcccctgcacccagcatgctccgacacagcagggaagctcctcctgtggcccggacacccatagacggtgcggggggcctggctgggccagaccccaggaaggtggggtagactggggggatcagctgcccattgctcccaagaggaggagagggaggctgcagatgcctgggactcagaccaggaagctgtgggccctcctgctccacccccatcccactcccacccatgtctgggctcccaggcagggaacccgatctcttcctttgtgctggggccaggcgagtggagaaacgccctccagtctgagagcaggggagggaaggaggcagcagagttggggcagctgctcagagcagtgttctggcttcttctcaaaccctgagcgggctgccggcctccaagttcctccgacaagatgatggtactaattatggtacttttcactcactttgcacctttccctgtcgctctctaagcactttacctggatggcgcgtgggcagtgtgcaggcaggtcctgaggcctggggttggggtggagggtgcggcccggagttgtccatctgtccatcccaacagcaagacgaggatgtggctgttgagatgtgggccacactcacccttgtccaggatgcagggactgccttctccttcctgcttcatccggcttagcttggggctggctgcattcccccaggatgggcttcgagaaagacaaacttgtctggaaaccagagttgctgattccacccggggggcccggctgactcgcccatcacctcatctccctgtggacttgggagctctgtgccaggcccaccttgcggccctggctctgagtcgctctcccacccagcctggacttggccccatgggacccatcctcagtgctccctccagatcccgtccggcagcttggcgtccaccctgcacagcatcactgaatcacagagcctttgcgtgaaacagctctgccaggccgggagctgggtttctcttccctttttatctgctggtgtggaccacacctgggcctggccggaggaagagagagtttaccaagagagatgtctccgggcccttatttattatttaaacatttttttaaaaagcactgctagtttacttgtctctcctccccatcgtccccatcgtcctccttgtccctgacttggggcacttccaccctgacccagccagtccagctctgccttgccggctctccagagtagacatagtgtgtggggttggagctctggcacccggggaggtagcatttccctgcagatggtacagatgttcctgccttagagtcatctctagttccccacctcaatcccggcatccagccttcagtcccgcccacgtgctagctccgtgggcccaccgtgcggccttagaggtttccctccttcctttccactgaaaagcacatggccttgggtgacaaattcctctttgatgaatgtaccctgtggggatgtttcatactgacagattatttttatttattcaatgtcatatttaaaatatttattttttataccaaatgaatacttttttttttaagaaaaaaaagagaaatgaataaagaatctactcttggctggcaaaaaaaaaaaaaaaaaa

SEQ ID NO: 146 - protein, 202 aa, Homo sapiens
  ref <308>: DATABASE ACCESSION NUMBER: NCBI / NP_002300.1
  ref <309>: DATABASE ENTRY DATE: 2018-09-30
  ref <313>: RELEVANT RESIDUES IN SEQ ID NO: (1)..(202)
MKVLAAGVVPLLLVLHWKHGAGSPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 147 - DNA, 2393 bp, Homo sapiens
  ref <308>: DATABASE ACCESSION NUMBER: NCBI / NM_001172632.1
  ref <309>: DATABASE ENTRY DATE: 2018-10-13
  ref <313>: RELEVANT RESIDUES IN SEQ ID NO: (1)..(2393)
attcttctattagataacagtagctatttaaatacttctgcagaagctcacatatttttagtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcaggacttcatccagcaagcaatttcctattccagttttccattctggatggggctgtctcggaggaaccccagctacccatggctctgggaggacggttctcctttgatgccccacttatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggtgcctggcacctttatgtcaacatttttgattctagctacctgtattatttcacctagcttgtcccaagcttccctgccagcctgaagtccattttcccctttttattttaaaatttgactcctcttcaagcttgaaaaccctctgaactcagtcttctttacctcattatcaccttcccctcacactcctaaaattgcatgaaagacagaacatggagaacttgctcaagtgcaggcagagagcaaaaaggggaaatatgtctgggaaaaagtgcacgtgaagaaacaaagaaggacagaggccattccgaaatcaagaaactcatgttcttaactttaaaaaaggtatcaatccttggtttttaaactgtggtccatctccagactctaccacttacggacagacagacagacagacacacacacacacacacacacacattttgggacaagtggggagcccaagaaagtaattagtaagtgagtggtcttttctgtaagctaatccacaacctgttaccacttcctgaatcagttattatttcttcatttttttttctaccagaggacagattaatagatttaacccttcacaacagttcttgttagaatcatgggatgtgtggcccagaggtaagaatagaatttctttccctaaagaacataccttttgtagatgaactcttctcaactctgttttgctatgctataattccgaaacatacaagacaaaaaaaatgaagacactcaatctagaacaaactaagccaggtatgcaaatatcgctgaatagaaacagatggaattagaaatatatcttctatttttaggcttctatttcctttccacccactcttcacaggctattctactttaaaggaagcctttttattttgctgcacacaatctagcaggaatctttttttttttttaagagctgtgtcatccttatgtaggcaagagatgtttgcttttgttaaaagctttattgagatataattaacataaaataaactgaacatatttaaagtgtactatttgataagttttcacaccttgtggagaacatgcatactacaattaagagagtgaacatatccatcatccctcaaagtgtcacaatgctcctcctgatgactcctccccagaaaaccaccaatcggctttcattttgcattttgtagttttatgtgaatggaatcatatagtatgtcttttttttttgtctggcttctttcactttgcataattattttgagattcatatgtctccatcttgatgctcgtatgaattcattcttttaaatgttgaatattcccttgtatggatataccacaattcatttacccatttacttgttgatgacatttgggttgttttagttttgggatattacaaataaagctgctgtgaacatttgtgtacaagaaaaaaaaaaaaaaaaa

SEQ ID NO: 148 - protein, 181 aa, Homo sapiens
  ref <308>: DATABASE ACCESSION NUMBER: NCBI / NP_001166103.1
  ref <309>: DATABASE ENTRY DATE: 2018-10-13
  ref <313>: RELEVANT RESIDUES IN SEQ ID NO: (1)..(181)
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSGLHPASNFLFQFSILDGAVSEEPQLPMALGGRFSFDAPLI

SEQ ID NO: 149 - DNA, 2417 bp, Homo sapiens
  ref <308>: DATABASE ACCESSION NUMBER: NCBI / NM_001172633.1
  ref <309>: DATABASE ENTRY DATE: 2018-10-13
  ref <313>: RELEVANT RESIDUES IN SEQ ID NO: (1)..(2417)
attcttctattagataacagtagctatttaaatacttctgcagaagctcacatatttttagtttgttgaagttcgtgactgcttcactctctcattcttagcttgaatttggaaatgacttttgatgacctaaagatccagactgtgaaggaccagcctgatgagaagtcaaatggaaaaaaagctaaaggtcttcagtttctttactctccatggtggtgcctggctgctgcgactctaggggtcctttgcctgggattagtagtgaccattatggtgctgggcatgcaattatcccaggtgtctgacctcctaacacaagagcaagcaaacctaactcaccagaaaaagaaactggagggacagatctcagcccggcaacaagcagaagaagcttcacaggagtcagaaaacgaactcaaggaaatgatagaaacccttgctcggaagctgaatgagaaatccaaagagcaaatggaacttcaccaccagaatctgaatctccaagaaacactgaagagagtagcaaattgttcagctccttgtccgcaagactggatctggcatggagaaaactgttacctattttcctcgggctcatttaactgggaaaagagccaagagaagtgcttgtctttggatgccaagttgctgaaaattaatagcacagctgatctgatttagagtccgaggcgctgtctcccagacatacccttcaggtacctgtgcatatatacaacgaggagctgtttatgcggaaaactgcattttagctgccttcagtatatgtcagaagaaggcaaacctaagagcacagtgaatttgaaggctctggaagaaaagaaaaaagtctttgagttttattctggaatttaagctattctttgtcacttgggtgccaaacatgagagcccagaaaactgtcatttagctggctgcagaactcctttgcagaaactggggttccaggtgcctggcacctttatgtcaacatttttgattctagctacctgtattatttcacctagcttgtcccaagcttccctgccagcctgaagtccattttcccctttttattttaaaatttgactcctcttcaagcttgaaaaccctctgaactcagtcttctttacctcattatcaccttcccctcacactcctaaaattgcatgaaagacagaacatggagaacttgctcaagtgcaggcagagagcaaaaaggggaaatatgtctgggaaaaagtgcacgtgaagaaacaaagaaggacagaggccattccgaaatcaagaaactcatgttcttaactttaaaaaaggtatcaatccttggtttttaaactgtggtccatctccagactctaccacttacggacagacagacagacagacacacacacacacacacacacacattttgggacaagtggggagcccaagaaagtaattagtaagtgagtggtcttttctgtaagctaatccacaacctgttaccacttcctgaatcagttattatttcttcatttttttttctaccagaggacagattaatagatttaacccttcacaacagttcttgttagaatcatgggatgtgtggcccagaggtaagaatagaatttctttccctaaagaacataccttttgtagatgaactcttctcaactctgttttgctatgctataattccgaaacatacaagacaaaaaaaatgaagacactcaatctagaacaaactaagccaggtatgcaaatatcgctgaatagaaacagatggaattagaaatatatcttctatttttaggcttctatttcctttccacccactcttcacaggctattctactttaaaggaagcctttttattttgctgcacacaatctagcaggaatctttttttttttttaagagctgtgtcatccttatgtaggcaagagatgtttgcttttgttaaaagctttattgagatataattaacataaaataaactgaacatatttaaagtgtactatttgataagttttcacaccttgtggagaacatgcatactacaattaagagagtgaacatatccatcatccctcaaagtgtcacaatgctcctcctgatgactcctccccagaaaaccaccaatcggctttcattttgcattttgtagttttatgtgaatggaatcatatagtatgtcttttttttttgtctggcttctttcactttgcataattattttgagattcatatgtctccatcttgatgctcgtatgaattcattcttttaaatgttgaatattcccttgtatggatataccacaattcatttacccatttacttgttgatgacatttgggttgttttagttttgggatattacaaataaagctgctgtgaacatttgtgtacaagaaaaaaaaaaaaaaaaa

SEQ ID NO: 150 - protein, 189 aa, Homo sapiens
  ref <308>: DATABASE ACCESSION NUMBER: NCBI / NP_001166104.1
  ref <309>: DATABASE ENTRY DATE: 2018-10-13
  ref <313>: RELEVANT RESIDUES IN SEQ ID NO: (1)..(189)
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDAKLLKINSTADLI

SEQ ID NO: 151 - DNA, 1001 bp, Homo sapiens
  ref <308>: DATABASE ACCESSION NUMBER: NCBI / NM_002777.3
  ref <309>: DATABASE ENTRY DATE: 2018-10-13
  ref <313>: RELEVANT RESIDUES IN SEQ ID NO: (1)..(1001)
cgtgggtgcaccctggaccccaccatggctcaccggccccccagccctgccctggcgtccgtgctgctggccttgctgctgagcggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacataccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactcc

SEQ ID NO: 152 - protein, 256 aa, Homo sapiens
  ref <308>: DATABASE ACCESSION NUMBER: NCBI / NP_002768.3
  ref <309>: DATABASE ENTRY DATE: 2018-10-13
  ref <313>: RELEVANT RESIDUES IN SEQ ID NO: (1)..(256)
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 153 - DNA, 4507 bp, Homo sapiens
  ref <308>: DATABASE ACCESSION NUMBER: NCBI / NM_000963.3
  ref <309>: DATABASE ENTRY DATE: 2018-10-14
  ref <313>: RELEVANT RESIDUES IN SEQ ID NO: (1)..(4507)
gaccaattgtcatacgacttgcagtgagcgtcaggagcacgtccaggaactcctcagcagcgcctccttcagctccacagccagacgccctcagacagcaaagcctacccccgcgccgcgccctgcccgccgctgcgatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtgttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactgtcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagtagaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatcttaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataatgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactatttaaaaattgacagatcttttctgaagaaaaaaaaaaaaaaa

SEQ ID NO: 154 - protein, 604 aa, Homo sapiens
  ref <308>: DATABASE ACCESSION NUMBER: NCBI  / NP_000954.1
  ref <309>: DATABASE ENTRY DATE: 2018-10-14
  ref <313>: RELEVANT RESIDUES IN SEQ ID NO: (1)..(604)
MLARALLLCAVLALSHTANPCCSHPCQNRGVCMSVGFDQYKCDCTRTGFYGENCSTPEFLTRIKLFLKPTPNTVHYILTHFKGFWNVVNNIPFLRNAIMSYVLTSRSHLIDSPPTYNADYGYKSWEAFSNLSYYTRALPPVPDDCPTPLGVKGKKQLPDSNEIVEKLLLRRKFIPDPQGSNMMFAFFAQHFTHQFFKTDHKRGPAFTNGLGHGVDLNHIYGETLARQRKLRLFKDGKMKYQIIDGEMYPPTVKDTQAEMIYPPQVPEHLRFAVGQEVFGLVPGLMMYATIWLREHNRVCDVLKQEHPEWGDEQLFQTSRLILIGETIKIVIEDYVQHLSGYHFKLKFDPELLFNKQFQYQNRIAAEFNTLYHWHPLLPDTFQIHDQKYNYQQFIYNNSILLEHGITQFVESFTRQIAGRVAGGRNVPPAVQKVSQASIDQSRQMKYQSFNEYRKRFMLKPYESFEELTGEKEMSAELEALYGDIDAVELYPALLVEKPRPDAIFGETMVEVGAPFSLKGLMGNVICSPAYWKPSTFGGEVGFQIINTASIQSLICNNVKGCPFTSFSVPDPELIKTVTINASSSRSGLDDINPTVLLKERSTEL

SEQ ID NO: 155 - DNA, 2354 bp, Homo sapiens
  ref <308>: DATABASE ACCESSION NUMBER: NCBI / NM_002546.3
  ref <309>: DATABASE ENTRY DATE: 2018-09-16
  ref <313>: RELEVANT RESIDUES IN SEQ ID NO: (1)..(2354)
tttttttcccctgctctcccaggggccagacaccaccgccccacccctcacgccccacctccctgggggatcctttccgccccagccctgaaagcgttaaccctggagctttctgcacaccccccgaccgctcccgcccaagcttcctaaaaaagaaaggtgcaaagtttggtccaggatagaaaaatgactgatcaaaggcaggcgatacttcctgttgccgggacgctatatataacgtgatgagcgcacgggctgcggagacgcaccggagcgctcgcccagccgccgcctccaagcccctgaggtttccggggaccacaatgaacaacttgctgtgctgcgcgctcgtgtttctggacatctccattaagtggaccacccaggaaacgtttcctccaaagtaccttcattatgacgaagaaacctctcatcagctgttgtgtgacaaatgtcctcctggtacctacctaaaacaacactgtacagcaaagtggaagaccgtgtgcgccccttgccctgaccactactacacagacagctggcacaccagtgacgagtgtctatactgcagccccgtgtgcaaggagctgcagtacgtcaagcaggagtgcaatcgcacccacaaccgcgtgtgcgaatgcaaggaagggcgctaccttgagatagagttctgcttgaaacataggagctgccctcctggatttggagtggtgcaagctggaaccccagagcgaaatacagtttgcaaaagatgtccagatgggttcttctcaaatgagacgtcatctaaagcaccctgtagaaaacacacaaattgcagtgtctttggtctcctgctaactcagaaaggaaatgcaacacacgacaacatatgttccggaaacagtgaatcaactcaaaaatgtggaatagatgttaccctgtgtgaggaggcattcttcaggtttgctgttcctacaaagtttacgcctaactggcttagtgtcttggtagacaatttgcctggcaccaaagtaaacgcagagagtgtagagaggataaaacggcaacacagctcacaagaacagactttccagctgctgaagttatggaaacatcaaaacaaagaccaagatatagtcaagaagatcatccaagatattgacctctgtgaaaacagcgtgcagcggcacattggacatgctaacctcaccttcgagcagcttcgtagcttgatggaaagcttaccgggaaagaaagtgggagcagaagacattgaaaaaacaataaaggcatgcaaacccagtgaccagatcctgaagctgctcagtttgtggcgaataaaaaatggcgaccaagacaccttgaagggcctaatgcacgcactaaagcactcaaagacgtaccactttcccaaaactgtcactcagagtctaaagaagaccatcaggttccttcacagcttcacaatgtacaaattgtatcagaagttatttttagaaatgataggtaaccaggtccaatcagtaaaaataagctgcttataactggaaatggccattgagctgtttcctcacaattggcgagatcccatggatgagtaaactgtttctcaggcacttgaggctttcagtgatatctttctcattaccagtgactaattttgccacagggtactaaaagaaactatgatgtggagaaaggactaacatctcctccaataaaccccaaatggttaatccaactgtcagatctggatcgttatctactgactatattttcccttattactgcttgcagtaattcaactggaaattaaaaaaaaaaaactagactccattgtgccttactaaatatgggaatgtctaacttaaatagctttgagatttcagctatgctagaggcttttattagaaagccatatttttttctgtaaaagttactaatatatctgtaacactattacagtattgctatttatattcattcagatataagatttgtacatattatcatcctataaagaaacggtatgacttaattttagaaagaaaattatattctgtttattatgacaaatgaaagagaaaatatatatttttaatggaaagtttgtagcatttttctaataggtactgccatatttttctgtgtggagtatttttataattttatctgtataagctgtaatatcattttatagaaaatgcattatttagtcaattgtttaatgttggaaaacatatgaaatataaattatctgaatattagatgctctgagaaattgaatgtaccttatttaaaagattttatggttttataactatataaatgacattattaaagttttcaaattattttttaaaaaaaaa

SEQ ID NO: 156 - protein, 401 aa, Homo sapiens
  ref <308>: DATABASE ACCESSION NUMBER: NCBI / NP_002537.3
  ref <309>: DATABASE ENTRY DATE: 2018-09-16
  ref <313>: RELEVANT RESIDUES IN SEQ ID NO: (1)..(401)
MNNLLCCALVFLDISIKWTTQETFPPKYLHYDEETSHQLLCDKCPPGTYLKQHCTAKWKTVCAPCPDHYYTDSWHTSDECLYCSPVCKELQYVKQECNRTHNRVCECKEGRYLEIEFCLKHRSCPPGFGVVQAGTPERNTVCKRCPDGFFSNETSSKAPCRKHTNCSVFGLLLTQKGNATHDNICSGNSESTQKCGIDVTLCEEAFFRFAVPTKFTPNWLSVLVDNLPGTKVNAESVERIKRQHSSQEQTFQLLKLWKHQNKDQDIVKKIIQDIDLCENSVQRHIGHANLTFEQLRSLMESLPGKKVGAEDIEKTIKACKPSDQILKLLSLWRIKNGDQDTLKGLMHALKHSKTYHFPKTVTQSLKKTIRFLHSFTMYKLYQKLFLEMIGNQVQSVKISCL

SEQ ID NO: 157 - DNA, 2128 bp, Homo sapiens
  ref <308>: DATABASE ACCESSION NUMBER: NCBI / NM_001242589.2
  ref <309>: DATABASE ENTRY DATE: 2018-10-14
  ref <313>: RELEVANT RESIDUES IN SEQ ID NO: (1)..(2128)
gtgcaactttccgaagcctctaggtcattgtggtgccttgtagctgtcccgggagccctcagcagcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcaggtatagtttccaggtccctgggcccctggtttggacactgagccctttgtttcccagtctgtgtgctgagaggatgtgaaagtgagggaaaggggagggtggggcaggagaagacttgagtcacattagtctgggtagaaatgtccaggggaagaaggaagtggtgatggagaataggggaggctctcagccaggctgtccttctccccagttcaccttctttgtttccttgcaacctgagtattaaagagagggaaatggcatcttccccaagttccagtggagctcatccaaccccaggggcctgatgggcagtgggaaagcactctgagtgaggggccctggatctagtgttggcctgactaactgaatgtgactttgggtgagtcaggaaccctctctggctttagcttctttgacaattcagtaggcatggtagaaacccaaagctggaagacattgtccacctaataactctcagcaggagctggagctggggctaaatgcagtattggtttttgccttattgttttttaaataacattgttgcatgtgcccaattatagataaatagaatcagaatttttgcagatgaggtccctctcagtatttttaataagatgtttaggagatttctaatgtgtaggcaaacttaagaaccactaacttagcaatttcacacctctttacagttattaaatgttgatttatattagaatgtgtttatcattaaatactgaattatcaggatggaaatacttttccacatcaccactagtctaacatgtcttttttctcatattctcttctagtctttattcatgtttatacatattttaatatggcagtaagtctaattatacatgtttttattcttttccttgctgaaattattctttgatgctgctacctaaatttcataaatataatttcaatgagtgcatatttttctatcaattgggaaagccataacttacataaccattggcctgttcttagacattgatatagtgttgataactctgagataaacatattcttgcagatatatttttcttcttttaaataattaactcgaaatttccatgagataatttaaacactgatatcattttgtatacaaatagcatctaccaatggtcttccaaaagattggaaacaatttgcagtgtgatccattaagcataaataaagcagtgtcatggcaggcttacagacacggatttagtcttttaaatcattaaatagtgtgagttaaatcacattcctgctaaaacaaatgtgaactggtgcctgctctaatttctctatgagtgtagactccacctccatatgggtagtggcagtgcctttttccccattatgttgtttggggaacaaagtgctcattaaacttctgtggaataaatcaaacgaatgatcaaaaaaaaaaaaaaaaa

SEQ ID NO: 158 - protein, 225 aa, Homo sapiens
  ref <308>: DATABASE ACCESSION NUMBER: NCBI / NP_001229518.1
  ref <309>: DATABASE ENTRY DATE: 2018-10-14
  ref <313>: RELEVANT RESIDUES IN SEQ ID NO: (1)..(225)
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRYSFQVPGPLVWTLSPLFPSLCAERM

SEQ ID NO: 159 - DNA, 3140 bp, Homo sapiens
  ref <308>: DATABASE ACCESSION NUMBER: NCBI /  NM_001242590.2
  ref <309>: DATABASE ENTRY DATE: 2018-10-14
  ref <313>: RELEVANT RESIDUES IN SEQ ID NO: (1)..(3140)
gtgcaactttccgaagcctctaggtcattgtggtgccttgtagctgtcccgggagccctcagcagcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaaggggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccggctatttctaaagtcagcgtctcaccttcctgcccactgccctcgttcctctaataatcttgggtgggcatttgtgcctcagaaaagaagttacagccccaaacatgcttggtccttcattccaccagccacttggggttggcatgaaatacagacagctcaatgcttttcaccgtaattctcttgtgggggctgtgacatgcagaaggcacacctgatacttctcctgctcagttttgccctggaccatacaattttggcctgacctggacagagctcccactacagaagcatcctgctcgccccatgctgggacttcctctttctagcatcagacacttgggtttcatgcttatgtgtggttctttccaacactcccagaaaagggtgttgaagattgtggaacctggagaaataagacatcgtggtgagaaagtgcatccttctcagagaaaagagttaaactgagtatcttcttctggggaaatactggcaggccgagatgggatccataggagagcaacaacagaccatgtcagacatcctgtgtgcatttatcgctggatcctgaaaatagccccgtgaaggcagaaatgtatgtgactagaacgaggccacatgaataagccactgcccactggcaggagtgaaaactgaagcgctccttacctgaaggaccccaaaaccatatagaatagaataaccaggagttccgcctgtgtctaaatgcctcttttcctgtatcacacaagggtcagggatggtggagtaaaagctctccccctgggaggcttctggaggctgtccccatgtgcttgcctagttccccactctgccctcctcctcttctctcagtctgctcctggaacacctgcctcagtttccatgctctctccagtgccctccccggtgaagcaggtaggtgttcaggccaccacagagacaatctctgtgggagattgtcttgcaatctcccacagatttcaatcaggattttgttatttcctactttgagctttaaagggaaatgggcctcatgggtggggaaaggatggtgggtccttccagcccaatttagtgatgcccagggcagatattatcctcagttcccaagagcaatcatacttttccacacataccgtgtgtctcatgttaggtaaatgtatttttacaatgagcaccacttctgtggaaaaagttccctgcacggggaggtccagcttccagactgctccatcgcataaggacttccccattcccctaaatgctgctctgtcagaacctgcccaggtaatggtaatgaccctagagagatgatttctgaaccgcaattttgagcccattagaaggtgtgtggtgggcatttatttcatcctgatgctctggtgagaatctttgcagacgcactagatccagaagctgttaatcttggtgcatttattttcctacctaaaagaaccaagcagctcagaggcagtgactgtacaggatgcagtgtttataataatgctgagcttgctggtctggaaccccacactttagcaatcccagcattgttcctgtttatgaagttgacaaagtgaccagggcaagggggtattatcattaaatacactctaggagaggcagaacacatgagggcaatgtttttcagaggtctttaggccaccgcatcagattctcctggagcataaagcaaatgctttatgagtccagggcccctgcagacctactgtatactagtatacagctccctcttagtggatctcaagcttgtttccaaaaagtcattacactccttaccaaagcccatgacacattcatacagattcatccagacataacccactgcatggtccagtgcatgcttgtgtgcttaacttattatagatcaagtgttatttaagtccaacatattaaacgtgactgaaatattatatgcactaaatcggaagacaaatggccgtgctggatactctcccatttgcacttacaggccacgccatgctccatcctccccatcctgcctgggaacctgaccaatgtggctaaaccagcaggctccctggctgccagcttctggctggttgagccaatgggaagcatgagaggagagccgagggtggggagacagtcagatcagggtttctgtcctcagggctccctccctggcaggtggtggcaggagtggctgcattcccctctgaaggctccttcaagcctctcagcaaacagctcccatctccaagtccagccacctgttccatcctctcctctgtaggcccagcagtgggaatgacccaccactattgccagcctcagcatactgaagcaccccttactggattccctaaattctatgcacatgtttattaaatgctcctcaattacccagttaaaaaaaaaaaaaaaaaa

SEQ ID NO: 160 - protein, 150 aa, Homo sapiens
  ref <308>: DATABASE ACCESSION NUMBER: NCBI / NP_001229519.1
  ref <309>: DATABASE ENTRY DATE: 2018-10-14
  ref <313>: RELEVANT RESIDUES IN SEQ ID NO: (1)..(150)
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFRCSTLSFSWLVDS

SEQ ID NO: 161 - DNA, 3677 bp, Homo sapiens
  ref <308>: DATABASE ACCESSION NUMBER: NCBI / NM_001025366.2
  ref <309>: DATABASE ENTRY DATE: 2018-09-22
  ref <313>: RELEVANT RESIDUES IN SEQ ID NO: (1)..(3677)
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 162 - protein, 412 aa, Homo sapiens
  ref <308>: DATABASE ACCESSION NUMBER: NCBI / NP_00102537.2
  ref <309>: DATABASE ENTRY DATE: 2018-09-22
  ref <313>: RELEVANT RESIDUES IN SEQ ID NO: (1)..(412)
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 163 - DNA, 3608 bp, Homo sapiens
  ref <308>: DATABASE ACCESSION NUMBER: NCBI / NM_001025367.2
  ref <309>: DATABASE ENTRY DATE: 2018-09-22
  ref <313>: RELEVANT RESIDUES IN SEQ ID NO: (1)..(3608)
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccgtccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 164 - protein, 389 aa, Homo sapiens
  ref <308>: DATABASE ACCESSION NUMBER: NCBI  / NP_001020538.2
  ref <309>: DATABASE ENTRY DATE: 2018-09-22
  ref <313>: RELEVANT RESIDUES IN SEQ ID NO: (1)..(389)
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 165 - DNA, 1914 bp, Homo sapiens
  ref <308>: DATABASE ACCESSION NUMBER: NCBI / NM_001142797.1
  ref <309>: DATABASE ENTRY DATE: 2018-09-02
  ref <313>: RELEVANT RESIDUES IN SEQ ID NO: (1)..(1914)
ccaaccacaagcaccaaagcagaggggcaggcagcacaccacccagcagccagagcaccagcccagccatggtccttgaggggtccctgggccgatgggatcacgcagaagaatgcgagagaagcagcctttgagaagggaagtcactatcccagagcccaggctgagcggatggagttgaggaagtacggccctggaagactggcggggacagttataggaggagctgctcagagtaaatcacagactaaatcagactcaatcacaaaagagttcctgccaggcctttacacagccccttcctccccgttcccgccctcacaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaatatcctcgctcccgggactcactggcagccccagcaccaccaggtctcccgggaagccaccctcccagctctgaggactgcaccattgctgctccttagctgccaagccccatcctgccgcccgaggtggctgcctggagccccactgcccttctcatttggaaactaaaacttcatcttccccaagtgcggggagtacaaggcatggcgtagagggtgctgccccatgaagccacagcccaggcctccagctcagcagtgactgtggccatggtccccaagacctctatatttgctcttttatttttatgtctaaaatcctgcttaaaacttttcaataaacaagatcgtcaggaccaaaaaaaaaaaaaaaaaaaaaaaaaaaaaaaaaaaaaaaaaaaaaaa

SEQ ID NO: 166 - protein, 415 aa, Homo sapiens
  ref <308>: DATABASE ACCESSION NUMBER: NCBI /  NP_001136269.1
  ref <309>: DATABASE ENTRY DATE: 2018-09-02
  ref <313>: RELEVANT RESIDUES IN SEQ ID NO: (1)..(415)
MELRKYGPGRLAGTVIGGAAQSKSQTKSDSITKEFLPGLYTAPSSPFPPSQVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 167 - DNA, 1670 bp, Homo sapiens
  ref <308>: DATABASE ACCESSION NUMBER: NCBI / NM_001504.1
  ref <309>: DATABASE ENTRY DATE: 2018-09-02
  ref <313>: RELEVANT RESIDUES IN SEQ ID NO: (1)..(1670)
ccaaccacaagcaccaaagcagaggggcaggcagcacaccacccagcagccagagcaccagcccagccatggtccttgaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaatatcctcgctcccgggactcactggcagccccagcaccaccaggtctcccgggaagccaccctcccagctctgaggactgcaccattgctgctccttagctgccaagccccatcctgccgcccgaggtggctgcctggagccccactgcccttctcatttggaaactaaaacttcatcttccccaagtgcggggagtacaaggcatggcgtagagggtgctgccccatgaagccacagcccaggcctccagctcagcagtgactgtggccatggtccccaagacctctatatttgctcttttatttttatgtctaaaatcctgcttaaaacttttcaataaacaagatcgtcaggaccaaaaaaaaaaaaaaaaaaaaaaaaaaaaaaaaaaaaaaaaaaaaaaa

SEQ ID NO: 168 - protein, 368 aa, Homo sapiens
  ref <308>: DATABASE ACCESSION NUMBER: NCBI / NP_001495.1
  ref <309>: DATABASE ENTRY DATE: 2018-09-02
  ref <313>: RELEVANT RESIDUES IN SEQ ID NO: (1)..(368)
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 169 - DNA, 1342 bp, Homo sapiens
  ref <308>: DATABASE ACCESSION NUMBER: NCBI / NM_001329099.1
  ref <309>: DATABASE ENTRY DATE: 2018-06-15
  ref <313>: RELEVANT RESIDUES IN SEQ ID NO: (1)..(1342)
cttagctgaagatgactgacagtgttatttattccatgttagagttgcctacggcaacccaagcccagaatgactatggaccacagcaaaaatcttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttgtgcagacatgcggtgccatcaacaaaaatggtcttcaagcctcaagctgtgaagttcctttacactgggtgtgtaagaagtgtccctttgcagatcaagctttattctgaagaataaacctagctggcatgctggtgtgtacctgtagtcctagctatttgggaagctgaggtgggagggtcgcttgagcccaggagtttgaggctgcagtgagctatgattgtgccactgtactccagcctgggagatagagcaagactccatctctaaaaaaaaaaaaaaatgctaatgtgagaatataaattgtgggaaatgagtgagggcaaggtggtacttcctccttctgagctcttcacacgtaatgcaaaaacccggtcttaactgattttgttttttttctgagtatgcatatatgtggttgaatgaaccaatgtgtgattgtatcttttccattatgtgactgtttgacctgcatattaatttcaagatagcagtcaattcgataaggcattttcatagaggaaagtttacagaaacagtttatgtggttggatcaccaaattatcttaggtactaaggcctcaaaaataagaaaaactttattatttctcctcagtagagtttggacatacataaggagagaaggtacagtgatgaaggagaccataattctgtagtgttgatgatcctggattataatctttttctctttatctttcatagtttttttaaaaacatggactgtatcttatctaccactatatcccaaatacctaagatagtgcttacgttcagtgactattaaataaataaatggatgaattaaaaaaaaaaaaaaaaaaaaaaaaaaaaa

SEQ ID NO: 170 - protein, 195 aa, Homo sapiens
  ref <308>: DATABASE ACCESSION NUMBER: NCBI / NP_001316028.1
  ref <309>: DATABASE ENTRY DATE: 2018-06-15
  ref <313>: RELEVANT RESIDUES IN SEQ ID NO: (1)..(195)
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCKKCPFADQALF

SEQ ID NO: 171 - DNA, 1891 bp, Homo sapiens
  ref <308>: DATABASE ACCESSION NUMBER: NCBI  / NM_001329101.1
  ref <309>: DATABASE ENTRY DATE: 2018-07-01
  ref <313>: RELEVANT RESIDUES IN SEQ ID NO: (1)..(1891)
agttctcacgctaggtctcctccgggcgcttccctagcccgttcgccgcctgagagggacgctgttccgccgcgtggaagcttcgagtctcgactccactgttgacccctagacgagagtagtgcagcgacggggccgtgatgtgcgtcctggctttcttaacgacacctctcctctgtatttcctttttccacttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttgtgcagacatgcggtgccatcaacaaaaatggtcttcaagcctcaagctgtgaagttcctttacactgggtgtgtaagaaggtcagactttgatagatgaccactctgtcctgaccctcagatctgtcatgtatccctaaaaggagggagctggccactggctgttgggaaagccatgagtatatagttagcaaatactgaactttctcagatatggcattagatgcaagacaacctcctagggattgatgcctaactgatggattctctttgagactatttagatattatgtgagcaatttaaagaccagatctaagcaaattttgaaatagatgtttgttttttgtatttctcagtatggaaactaatgctgccactctcatccccgtcccaaccatctctgtcaaaaatatacctttttcatatgatattctgagctaatctgataaaatctatgccaatatatactattgcttgtgtactagagaagtacattattgctgtactcctctgtacattactgatccctgatggtatatttctatcctaacagtgtccctttgcagatcaagctttattctgaagaataaacctagctggcatgctggtgtgtacctgtagtcctagctatttgggaagctgaggtgggagggtcgcttgagcccaggagtttgaggctgcagtgagctatgattgtgccactgtactccagcctgggagatagagcaagactccatctctaaaaaaaaaaaaaaatgctaatgtgagaatataaattgtgggaaatgagtgagggcaaggtggtacttcctccttctgagctcttcacacgtaatgcaaaaacccggtcttaactgattttgttttttttctgagtatgcatatatgtggttgaatgaaccaatgtgtgattgtatcttttccattatgtgactgtttgacctgcatattaatttcaagatagcagtcaattcgataaggcattttcatagaggaaagtttacagaaacagtttatgtggttggatcaccaaattatcttaggtactaaggcctcaaaaataagaaaaactttattatttctcctcagtagagtttggacatacataaggagagaaggtacagtgatgaaggagaccataattctgtagtgttgatgatcctggattataatctttttctctttatctttcatagtttttttaaaaacatggactgtatcttatctaccactatatcccaaatacctaagatagtgcttacgttcagtgactattaaataaataaatggatgaattaaaaa

SEQ ID NO: 172 - protein, 110 aa, Homo sapiens
  ref <308>: DATABASE ACCESSION NUMBER: NCBI / NP_001316030.1
  ref <309>: DATABASE ENTRY DATE: 2018-07-01
  ref <313>: RELEVANT RESIDUES IN SEQ ID NO: (1)..(110)
MKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCKKVRL

SEQ ID NO: 173 - DNA, 1425 bp, Homo sapiens
  ref <308>: DATABASE ACCESSION NUMBER: NCBI / XM_011516459.2
  ref <309>: DATABASE ENTRY DATE: 2018-03-26
  ref <313>: RELEVANT RESIDUES IN SEQ ID NO: (1)..(1425)
acttggcaccaaggctgtcaccctgttacctccgggtcctttcctcctgcacgtcagctttgagccccgagctggtgcttctgctctctgagacatggcaggcctgatgaccatagtaaccagccttctgttccttggtgtctgtgcccaccacatcatccctacgggctctgtggtcatcccctctccctgctgcatgttctttgtttccaagagaattcctgagaaccgagtggtcagctaccagctgtccagcaggagcacatgcctcaaggcaggagtgatcttcaccaccaagaagggccagcagttctgtggcgaccccaagcaggagtgggtccagaggtacatgaagaacctggacgccaagcagaagaaggcttcccctagggccagggcagtggctgtcaagggccctgtccagagatatcctggcaaccaaaccacctgctaatccccgcccagccctccagccctgagtttgggcctgagctgcttggcgggctactcggggcctggagaagccacagtgatggggggaagagctaattttcctgtttcttagcaacactctccagggatgtgtctcttctatgaaaaacccgagggagcaggtgatgtggttcccgggggctgagcaatggctccaagcatccaaggccccttgcctttctggagctgggtgagaagatcccagaaggagagcagtggcaactctttgccttctcctcctgacctggttctgatgctttttcttttttttttttttctgagacggagtctcgctctgtcacccaggctggagtgcagtggcacaatctcggttcactgcaacctccgcctcctgggttcaagtgattctcgtgcctcagcctcccgagtacctgggactacaggtgtgtaccaccacacccaactaacttttgtatttttagtagagatgaggtttcaccatgttggccaggctggtctcaaactcctggcctcaagtgatctacctgcctcggcctcccaaagtgctgggattacaggcatgagccaccacacccagcctactcaaacttttatgttgaaaaaaaaaaatcataatttttttttttttaaaggaaatgaacgtggaggactggggtgaagggccagcctgggtagtttaatctttttgggaagacatgactttaaggagattccctgctttgtgacaggttgctccatgctgtcttggggacaagggcctgtactgccttcaaatctgggctcaccccacattttggtgaggggaagatagggtggggggattagggggagaaaagactctagctttttttttctatgcatgatatactgtgtgggtttatcaagagtgtagacacagttgctgttctcaaataataggccaaataaaatgcgattctttttttctttgaa

SEQ ID NO: 174 - protein, 119 aa, Homo sapiens
  ref <308>: DATABASE ACCESSION NUMBER: NCBI / XP_011514761.1
  ref <309>: DATABASE ENTRY DATE: 2018-03-26
  ref <313>: RELEVANT RESIDUES IN SEQ ID NO: (1)..(119)
MAGLMTIVTSLLFLGVCAHHIIPTGSVVIPSPCCMFFVSKRIPENRVVSYQLSSRSTCLKAGVIFTTKKGQQFCGDPKQEWVQRYMKNLDAKQKKASPRARAVAVKGPVQRYPGNQTTC

SEQ ID NO: 175 - DNA, 1598 bp, Homo sapiens
  ref <308>: DATABASE ACCESSION NUMBER: NCBI / XM_011516460.2
  ref <309>: DATABASE ENTRY DATE: 2018-03-26
  ref <313>: RELEVANT RESIDUES IN SEQ ID NO: (1)..(1598)
acccacacaggagtccctggtccagaggaagttgtttcagagttgatccatcatctattcattctgcaaatgctggccatggcacagagatgcttccacgagagaccatcgggggactgggaatctggtcggcgcgggaaggggccaagcaaagtccggctgcacagagagtcacagatttgaccgagttggaaactcaggaaacagggtcctttcctcctgcacgtcagctttgagccccgagctggtgcttctgctctctgagacatggcaggcctgatgaccatagtaaccagccttctgttccttggtgtctgtgcccaccacatcatccctacgggctctgtggtcatcccctctccctgctgcatgttctttgtttccaagagaattcctgagaaccgagtggtcagctaccagctgtccagcaggagcacatgcctcaaggcaggagtgatcttcaccaccaagaagggccagcagttctgtggcgaccccaagcaggagtgggtccagaggtacatgaagaacctggacgccaagcagaagaaggcttcccctagggccagggcagtggctgtcaagggccctgtccagagatatcctggcaaccaaaccacctgctaatccccgcccagccctccagccctgagtttgggcctgagctgcttggcgggctactcggggcctggagaagccacagtgatggggggaagagctaattttcctgtttcttagcaacactctccagggatgtgtctcttctatgaaaaacccgagggagcaggtgatgtggttcccgggggctgagcaatggctccaagcatccaaggccccttgcctttctggagctgggtgagaagatcccagaaggagagcagtggcaactctttgccttctcctcctgacctggttctgatgctttttcttttttttttttttctgagacggagtctcgctctgtcacccaggctggagtgcagtggcacaatctcggttcactgcaacctccgcctcctgggttcaagtgattctcgtgcctcagcctcccgagtacctgggactacaggtgtgtaccaccacacccaactaacttttgtatttttagtagagatgaggtttcaccatgttggccaggctggtctcaaactcctggcctcaagtgatctacctgcctcggcctcccaaagtgctgggattacaggcatgagccaccacacccagcctactcaaacttttatgttgaaaaaaaaaaatcataatttttttttttttaaaggaaatgaacgtggaggactggggtgaagggccagcctgggtagtttaatctttttgggaagacatgactttaaggagattccctgctttgtgacaggttgctccatgctgtcttggggacaagggcctgtactgccttcaaatctgggctcaccccacattttggtgaggggaagatagggtggggggattagggggagaaaagactctagctttttttttctatgcatgatatactgtgtgggtttatcaagagtgtagacacagttgctgttctcaaataataggccaaataaaatgcgattctttttttctttgaa

SEQ ID NO: 176 - protein, 119 aa, Homo sapiens; identical to SEQ ID NO: 174
  ref <308>: DATABASE ACCESSION NUMBER: NCBI / XP_011514762.1
  ref <309>: DATABASE ENTRY DATE: 2018-03-26
  ref <313>: RELEVANT RESIDUES IN SEQ ID NO: (1)..(119)

SEQ ID NO: 177 - DNA, 1506 bp, Homo sapiens
  ref <308>: DATABASE ACCESSION NUMBER: NCBI / NM_006404.4
  ref <309>: DATABASE ENTRY DATE: 2018-08-26
  ref <313>: RELEVANT RESIDUES IN SEQ ID NO: (1)..(1506)
gcaggagggaggccggccccctagtaggaaatgagacacagtagaaataacactttataagcctcttcctcctcccatctcctggcctccttccatcctcctctgcccagactccgcccctcccagacggtcctcacttctcttttccctagactgcagccagcggagcccgcagccggcccgagccaggaacccaggtccggagcctcaacttcaggatgttgacaacattgctgccgatactgctgctgtctggctgggccttttgtagccaagacgcctcagatggcctccaaagacttcatatgctccagatctcctacttccgcgacccctatcacgtgtggtaccagggcaacgcgtcgctggggggacacctaacgcacgtgctggaaggcccagacaccaacaccacgatcattcagctgcagcccttgcaggagcccgagagctgggcgcgcacgcagagtggcctgcagtcctacctgctccagttccacggcctcgtgcgcctggtgcaccaggagcggaccttggcctttcctctgaccatccgctgcttcctgggctgtgagctgcctcccgagggctctagagcccatgtcttcttcgaagtggctgtgaatgggagctcctttgtgagtttccggccggagagagccttgtggcaggcagacacccaggtcacctccggagtggtcaccttcaccctgcagcagctcaatgcctacaaccgcactcggtatgaactgcgggaattcctggaggacacctgtgtgcagtatgtgcagaaacatatttccgcggaaaacacgaaagggagccaaacaagccgctcctacacttcgctggtcctgggcgtcctggtgggcagtttcatcattgctggtgtggctgtaggcatcttcctgtgcacaggtggacggcgatgttaattactctccagccccctcagaaggggctggattgatggaggctggcaagggaaagtttcagctcactgtgaagccagactccccaactgaaacaccagaaggtttggagtgacagctcctttcttctcccacatctgcccactgaagatttgagggaggggagatggagaggagaggtggacaaagtacttggtttgctaagaacctaagaacgtgtatgctttgctgaattagtctgataagtgaatgtttatctatctttgtggaaaacagataatggagttggggcaggaagcctatggcccatcctccaaagacagacagaatcacctgaggcgttcaaaagatataaccaaataaacaagtcatccacaatcaaaatacaacattcaatacttccaggtgtgtcagacttgggatgggacgctgatataatagggtagaaagaagtaacacgaagaagtggtggaaatgtaaaatccaagtcatatggcagtgatcaattattaatcaattaataatattaataaatttcttatatttaaggcaaaaaaaaaaaaaaaaaaaaaaa

SEQ ID NO: 178 - protein, 238 aa, Homo sapiens
  ref <308>: DATABASE ACCESSION NUMBER: NCBI / NP_006395.2
  ref <309>: DATABASE ENTRY DATE: 2018-08-26
  ref <313>: RELEVANT RESIDUES IN SEQ ID NO: (1)..(238)
MLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 179 - DNA, 2512 bp, Homo sapiens
  ref <308>: DATABASE ACCESSION NUMBER: NCBI / NM_001031849.2
  ref <309>: DATABASE ENTRY DATE: 2018-10-14
  ref <313>: RELEVANT RESIDUES IN SEQ ID NO: (1)..(2512)
acacacagagtgatacaaatacctgcttgagcccctcagttattttctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaaaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatttttgagaatctgaatgttttctcattcacaaaagtatcccttctacccctatctggcgcagggctgaaatgtcatcattagaggttctgtcttctggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacctacaacgt

SEQ ID NO: 180 - protein, 380 aa, Homo sapiens
  ref <308>: DATABASE ACCESSION NUMBER: NCBI / NP_001027019.1
  ref <309>: DATABASE ENTRY DATE: 2018-10-14
  ref <313>: RELEVANT RESIDUES IN SEQ ID NO: (1)..(380)
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 181 - DNA, 6476 bp, Homo sapiens
  ref <308>: DATABASE ACCESSION NUMBER: NCBI / NM_001879.5
  ref <309>: DATABASE ENTRY DATE: 2018-10-14
  ref <313>: RELEVANT RESIDUES IN SEQ ID NO: (1)..(6476)
acacacagagtgatacaaatacctgcttgagcccctcagttattttctctcaagggctgaagtcagccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtggatgtggacgagtgcaaggagagggaggacgaggagctgtcctgtgaccactactgccacaactacattggcggctactactgctcctgccgcttcggctacatcctccacacagacaacaggacctgccgagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggaaatgagtgcccagagctacagcctcctgtccatgggaaaatcgagccctcccaagccaagtatttcttcaaagaccaagtgctcgtcagctgtgacacaggctacaaagtgctgaaggataatgtggagatggacacattccagattgagtgtctgaaggatgggacgtggagtaacaagattcccacctgtaaaattgtagactgtagagccccaggagagctggaacacgggctgatcaccttctctacaaggaacaacctcaccacatacaagtctgagatcaaatactcctgtcaggagccctattacaagatgctcaacaataacacaggtatatatacctgttctgcccaaggagtctggatgaataaagtattggggagaagcctacccacctgccttccagtgtgtgggctccccaagttctcccggaagctgatggccaggatcttcaatggacgcccagcccagaaaggcaccactccctggattgccatgctgtcacacctgaatgggcagcccttctgcggaggctcccttctaggctccagctggatcgtgaccgccgcacactgcctccaccagtcactcgatccggaagatccgaccctacgtgattcagacttgctcagcccttctgacttcaaaatcatcctgggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggagccatggtcatcgtcagcggctgggggaagcagttcttgcaaaggttcccagagaccctgatggagattgaaatcccgattgttgaccacagcacctgccagaaggcttatgccccgctgaagaagaaagtgaccagggacatgatctgtgctggggagaaggaagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactgaatttggctcctcagccccagcaccaccagctgtgggcagtcagtagcagaggacgatcctccgatgaaagcagccatttctcctttccttcctcccatcccccctccttcggcctatccattactgggcaatagagcaggtatcttcacccccttttcactctctttaaagagatggagcaagagagtggtcagaacacaggccgaatccaggctctatcacttactagtttgcagtgctgggcaggtgacttcatctcttcgaacttcagtttcttcataagatggaaatgctataccttacctacctcgtaaaagtctgatgaggaaaagattaactaatagatgcatagcacttaacagagtgcatagcatacactgttttcaataaatgcaccttagcagaaggtcgatgtgtctaccaggcagacgaagctctcttacaaacccctgcctgggtcttagcattgatcagtgacacacctctcccctcaaccttgaccatctccatctgcccttaaatgctgtatgcttttttgccaccgtgcaacttgcccaacatcaatcttcaccctcatccctaaaaaagtaaaacagacaaggttctgagtcctgtggtatgtcccctagcaaatgtaactaggaacatgcactagatgacagattgcgggagggcctgagagaagcagggacaggagggagcctggggattgtggtttgggaaggcagacacctggttctagaactagctctgcccttagccccctgtatgaccctatgcaagtcctcctccctcatctcaaagggtcctcaaagctctgacgatctaagatacaatgaagccattttccccctgataagatgaggtaaagccaatgtaaccaaaaggcaaaaattacaatcggttcaaaggaactttgatgcagacaaaatgctgctgctgctgctcctgaaatacccacccctttccactacgggtgggttcccaaggacatgggacaggcaaagtgtgagccaaaggatccttccttattcctaagcagagcatctgctctgggccctggcctccttcccttcttgggaaactgggctgcatgaggtgggccctggtagtttgtaccccaggcccctatactcttccttcctatgtccacagctgaccccaagcagccgttccccgactcctcacccctgagcctcaccctgaactccctcatcttgcaaggccataagtgttttccaagcaaaatgcctctcccatcctctctcaggaagcttctagagactttatgccctccagagctccaagatataagccctccaagggatcagaagctccaagttcctgtcttctgttttatagaaattgatcttccctgggggactttaactcttgacctgtatgcagctgttggagtaattccaggtctcttgaaaaaaaagaggaagataatggagaatgagaacatatatatatatatattaagccccaggctgaatactcagggacagcaattcacagcctgcctctggttctataaacaagtcattctacctctttgtgccctgctgtttattctgtaaggggaaggtggcaatgggacccagctccatcagacacttgtcaagctagcagaaactccattttcaatgccaaagaagaactgtaatgctgttttggaatcatcccaaggcatcccaagacaccatatcttcccatttcaagcactgcctgggcacaccccaacatcccaggctgtggtggctcctgtgggaactacctagatgaagagagtatcatttataccttctaggagctcctattgggagacatgaaacatatgtaattgactaccatgtaatagaacaaaccctgccaagtgctgctttggaaagtcatggaggtaaaagaaagaccattctggtatgaaggttttgggggaggagatatcaatcaagaaggcttcccagaagaggtgactggaccagagccttgtccacaggtaagacggaggaggccttccacatggagggagaacaatagtaaatgtccactcaagatgtcctttattataccagctcctcccacaaaaacacatgtccagtggactctttttctgggatcagaaccaacaccaaaaagagcttttctccttaaagttagaattctaaacaggacttgaaatggcctcaaggtttgtgcacaaatactgacttctggctggacccagcttattctgtttatttctccaattgcaatttcatccttatcctgagaaaatgtctaaataggccatggaacccaggcttccccgtgacctacaagcacttattagctgtgccagctcctgcactgctgctaaggtccaagaaacccagatctctcacagagccatagaagcagagggctggagtatctgtgaggacaacaaccttgtctaacttcgcgacctcattcttgagcatttctactgatgagaaactcactacccccaattgcagctcattcaactttaaaattgctgctttttgaatcactgattgtgaatattaatttaaaaaaataagtaagaaaatgttttaaatgtgctgcctctttaaaaggtctcctctttgtgcaaccaaaacccacctctctagaatacagtttgtataactgaagctataatttcataccatgagtgctgctgttagcaataataatcatgcccggattttattaacaacagaagctgttgctcgtatgaaaaaacaaacattagttctaataaacatctgcattgagtcaaagctccctgtttgtttgtatgtcttttatgcactgatgattatagtgagttgctttcatttaccaacattttgttgtattcgtgtaggatcactgtaccatgaagggagagagactatgatgggaagattgttgtagatacaaaagcatgtcttaggtttttgggtcagttctgtttaaatacctgtcctattattcctgtaaattatcaaaatatcccagaatgtcaatgtttctgcatccacattacaattattaaatgccactcatttattaaatttactattatcagtggcatttaataaatttgaatcatatgttcagtgtttggtttagaaaatatggtgccatgtctatgagtggcctgttctggattggagtacatgccttctttctgccttgagttaatcttactcaatggagaacaagaatcaaagaaacaccaccaccaagaagcccttcaagctagagttgggcaagagtcagggaggggaatgtagaccactcatatgacagaggtggaaaccaatcttggtctagaataagtctcaaaatcaaaagacttgaattctagtgcagcgtaggttgactcccttatttatttaattttcccatctctacaccgctagaataacctctctcctgaggctgttgaatctgatgaattagcagataggaaagaacttagaaaattataagttcactcaaatgtaaaaggttatatgggaaataatcaccactaacatttttgagtacttactatctgcttgttatacacattctctaatttaattttcacaagaaaattcatgaaaggactatacttatcccccttttacaggtgagcaacctggagtgcagtgaagtgtaaaatgtgggccgacttaggagcacaaataccccagcaacaatgagcactcttagtacacaggtcttggtttctaaaatatcatcatccgataaaaggaacacaggctctttgaagaaatgactgattccgggattggggcaagaaacacacaagctgagactggagcatcttgcagtcccagaaagtgaagaaacgctgaggatatgtcaaagggacacaggagccaaatgaaagagcttccactggccaaagctggaatgttgagcaacaaagcaacatagcattggataataacccaaagtataaaataaatattcatgagtacata

SEQ ID NO: 182 - protein, 699 aa, Homo sapiens
  ref <308>: DATABASE ACCESSION NUMBER: NCBI / NP_001870.3
  ref <309>: DATABASE ENTRY DATE: 2018-10-14
  ref <313>: RELEVANT RESIDUES IN SEQ ID NO: (1)..(699)
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPVCGLPKFSRKLMARIFNGRPAQKGTTPWIAMLSHLNGQPFCGGSLLGSSWIVTAAHCLHQSLDPEDPTLRDSDLLSPSDFKIILGKHWRLRSDENEQHLGVKHTTLHPQYDPNTFENDVALVELLESPVLNAFVMPICLPEGPQQEGAMVIVSGWGKQFLQRFPETLMEIEIPIVDHSTCQKAYAPLKKKVTRDMICAGEKEGGKDACAGDSGGPMVTLNRERGQWYLVGTVSWGDDCGKKDRYGVYSYIHHNKDWIQRVTGVRN

SEQ ID NO: 183 - DNA, 6738 bp, Homo sapiens
  ref <308>: DATABASE ACCESSION NUMBER: NCBI / NM_000937.4
  ref <309>: DATABASE ENTRY DATE: 2018-09-22
  ref <313>: RELEVANT RESIDUES IN SEQ ID NO: (1)..(6738)
gagagcgcggccgggacggttggagaagaaggcggctcccggaagggggagagacaaactgccgtaacctctgccgttcaggaacccggttacttatttattcgttaccctttttcttcttcctcccccaaaaaccttttccttttcccttctttttttttcctttttgggagctgaaaaatttccggtaagggaaagaagggctcctttcgctccttatttccccgcctccttccctcccccaccttcccctcctccggctttttcctcccaactcggggaggtccttcccggtggccgccctgacgaggtctgagcacctaggcggaggcggcgcaggctttttgtagtgaggtttgcgcctgcgcagcgcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagctgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagtgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagcacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaacaacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcgccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccaacctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgctgtgcagttcttgcctccctcacggggcgtcacccccagcccagctccgttgtacataaatgccttgtggcagagctcccggtgaacttctggatcccgtttctgatgcagactcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaagt

SEQ ID NO: 184 - protein, 1970 aa, Homo sapiens
  ref <308>: DATABASE ACCESSION NUMBER: NCBI / NP_000928.1
  ref <309>: DATABASE ENTRY DATE: 2018-09-22
  ref <313>: RELEVANT RESIDUES IN SEQ ID NO: (1)..(1970)
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

---

What is claimed:

1. A method comprising measuring a level of expression of a gene in a sample obtained from a niche at an implantation site of a synthetic scaffold in a mammalian subject, wherein the synthetic scaffold comprises poly(e-caprolactone) (PCL), poly(lactide-co-glycolide) (PLG), poly(ethylene glycol) (PEG), and/or alginate, wherein the mammalian subject has or is suspected of having an autoimmune disease selected from multiple sclerosis and diabetes, and wherein:

(a) when the subject has or is suspected of having multiple sclerosis, the method comprises measuring the level of expression of:

(i) one or more of PRTN3, ELA2, LTF, CAMP, CHI3L3, S100A8, S100A9, IL8RB, CSF3, H2Q10, CD55, LEFTY, CCL22, IL12B, FOXP3, CXCR3, KLRG1, CCL24, PROCR, and MASP, or (ii) one or more of FN1, LIF, BDKRB1, TNFRSF11B, CFB, OLR1, CLEC7A, CXCL5, PTGS2, CXCL3, IL1F9, IL1B, TRM1, CXCL2, S100A9, CXCL1, IL6, EREG, VEGFA, CD163, and ADRB2; and (b) when the subject has or is suspected of having diabetes, the method comprises measuring the level of expression of one or more of CD163, PTGS2, TNFRSF11B, VEGFA, FN1, IL6, BDKRB1, S100A9, CXCL1, CXCL3, CFB, CLEC7A, IL1B, IL1F9, CXCL5, OLR1, LIF, CXCL2, TREM1, EREG, and ADRB2.

2. The method of claim 1, wherein the subject has received at least one treatment for the autoimmune disease.

3. The method of claim 1, comprising measuring the level of expression of the gene in a first sample obtained from the niche at a first time point and in a second sample obtained from the niche at a second time point, wherein the second time point is after the first time point.

4. The method of claim 3, wherein the subject has received at least one treatment for the autoimmune disease in between the first time point and the second time point.

5. The method of claim 1, wherein the multiple sclerosis is relapsing-remitting multiple sclerosis.

6. The method of claim 1, further comprising quantifying cell populations in the sample.

7. The method of claim 1, wherein the subject has or is suspected of having multiple sclerosis, and the method comprises measuring the level of expression of at least three of PRTN3, ELA2, LTF, CAMP, CHI3L3, S100A8, S100A9, IL8RB, CSF3, H2Q10, CD55, LEFTY, CCL22, IL12B, FOXP3, CXCR3, KLRG1, CCL24, PROCR, and MASP.

8. The method of claim 7, comprising measuring the level of expression of at least five of PRTN3, ELA2, LTF, CAMP, CHI3L3, S100A8, S100A9, IL8RB, CSF3, H2Q10, CD55, LEFTY, CCL22, IL12B, FOXP3, CXCR3, KLRG1, CCL24, PROCR, and MASP.

9. The method of claim 7, comprising measuring the level of expression of at least eight of PRTN3, ELA2, LTF, CAMP, CHI3L3, S100A8, S100A9, IL8RB, CSF3, H2Q10, CD55, LEFTY, CCL22, IL12B, FOXP3, CXCR3, KLRG1, CCL24, PROCR, and MASP.

10. The method of claim 1, wherein the subject has or is suspected of having multiple sclerosis, and the method comprises measuring the level of expression of at least three of FN1, LIF, BDKRB1, TNFRSF11B, CFB, OLR1, CLEC7A, CXCL5, PTGS2, CXCL3, IL1F9, IL1B, TRM1, CXCL2, S100A9, CXCL1, IL6, EREG, VEGFA, CD163, and ADRB2.

11. The method of claim 10, comprising measuring the level of expression of at least five of FN1, LIF, BDKRB1, TNFRSF11B, CFB, OLR1, CLEC7A, CXCL5, PTGS2, CXCL3, IL1F9, IL1B, TRM1, CXCL2, S100A9, CXCL1, IL6, EREG, VEGFA, CD163, and ADRB2.

12. The method of claim 10, comprising measuring the level of expression of at least eight of FN1, LIF, BDKRB1, TNFRSF11B, CFB, OLR1, CLEC7A, CXCL5, PTGS2, CXCL3, IL1F9, IL1B, TRM1, CXCL2, S100A9, CXCL1, IL6, EREG, VEGFA, CD163, and ADRB2.

13. The method of claim 1, wherein the subject has or is suspected of having diabetes, and the method comprises measuring the level of expression of at least three of CD163, PTGS2, TNFRSF11B, VEGFA, FN1, IL6, BDKRB1, S100A9, CXCL1, CXCL3, CFB, CLEC7A, IL1B, IL1F9, CXCL5, OLR1, LIF, CXCL2, TREM1, EREG, and ADRB2.

14. The method of claim 13, comprising measuring the level of expression of at least five of CD163, PTGS2, TNFRSF11B, VEGFA, FN1, IL6, BDKRB1, S100A9, CXCL1, CXCL3, CFB, CLEC7A, IL1B, IL1F9, CXCL5, OLR1, LIF, CXCL2, TREM1, EREG, and ADRB2.

15. The method of claim 13, comprising measuring the level of expression of at least eight of CD163, PTGS2, TNFRSF11B, VEGFA, FN1, IL6, BDKRB1, S100A9, CXCL1, CXCL3, CFB, CLEC7A, IL1B, IL1F9, CXCL5, OLR1, LIF, CXCL2, TREM1, EREG, and ADRB2.

* * * * *